US012774315B2

(12) United States Patent
Burrows et al.

(10) Patent No.: US 12,774,315 B2

(45) Date of Patent: Oct. 27, 2026

(54) T-CELL RECEPTORS AND USES THEREOF

(71) Applicant: The Council of the Queensland Institute of Medical Research, Hertson (AU)

(72) Inventors: Scott R. Burrows, Albany Creek (AU); Jacqueline M. Burrows, Albany Creek (AU); Penny L. Groves, Ferny Hills (AU)

(73) Assignee: The Council of the Queensland Institute of Medical Research (QIMR), Hertson (AU)

( * ) Notice: Subject to any disclaimer, the term of this patent is extended or adjusted under 35 U.S.C. 154(b) by 1320 days.

(21) Appl. No.: 17/288,524

(22) PCT Filed: Oct. 23, 2019

(86) PCT No.: PCT/AU2019/051165

§ 371 (c)(1),
(2) Date: Apr. 24, 2021

(87) PCT Pub. No.: WO2020/082130

PCT Pub. Date: Apr. 30, 2020

(65) Prior Publication Data

US 2021/0380657 A1 Dec. 9, 2021

(30) Foreign Application Priority Data

Oct. 25, 2018 (AU) ................................ 2018904049

(51) Int. Cl.

| | |
|---|---|
| ***C07K 14/705*** | (2006.01) |
| ***A61K 38/00*** | (2006.01) |
| ***A61K 40/11*** | (2025.01) |
| ***A61K 40/32*** | (2025.01) |
| ***A61K 40/46*** | (2025.01) |
| ***A61P 31/20*** | (2006.01) |
| ***A61P 35/00*** | (2006.01) |
| ***C07K 16/28*** | (2006.01) |
| ***G01N 33/569*** | (2006.01) |

(52) U.S. Cl.

CPC .......... *C07K 14/7051* (2013.01); *A61K 40/11* (2025.01); *A61K 40/32* (2025.01); *A61K 40/46* (2025.01); *A61P 31/20* (2018.01); *A61P 35/00* (2018.01); *C07K 16/2809* (2013.01); *G01N 33/56972* (2013.01); *A61K 38/00* (2013.01); *A61K 2239/31* (2023.05); *A61K 2239/38* (2023.05)

(58) Field of Classification Search

None

See application file for complete search history.

(56) References Cited

FOREIGN PATENT DOCUMENTS

| | | | |
|---|---|---|---|
| WO | 2006054096 | A2 | 5/2006 |
| WO | 2015160928 | A2 | 10/2015 |
| WO | 2016095783 | A1 | 6/2016 |
| WO | 2018129270 | A1 | 7/2018 |
| WO | 2018136762 | A1 | 7/2018 |

OTHER PUBLICATIONS

International Search Report for PCT/AU2019/051165 mailed Jan. 16, 2020 (8 pages).

Leb, V., et al., "Molecular and functional analysis of the antigen receptor of Art v1-specific helper T lymphocytes," Journal of Allergy and Clinical Immunology, vol. 121, No. 1, pp. 64-71 (2008).

*Primary Examiner* — Ruixiang Li

(74) *Attorney, Agent, or Firm* — McNeill PLLC

(57) ABSTRACT

Provided herein are isolated alpha and beta chains of a T-cell receptor (TCR) that is specific for an EBV antigen. Also described herein are TCRs having said alpha and beta chains and methods of making and using same, such as cellular immunotherapy in subjects having an EBV-associated disease, disorder or condition.

15 Claims, 116 Drawing Sheets

Specification includes a Sequence Listing.

TCRs specific for HLA-B*40:01-IEDPPFNSL

Donor N3M Clone 1 (IED)

Alpha chain:

ATGGAGACCCTGCTGGGCCTGCTGATCCTGTGGCTGCAGCTGCAGTGGGT 50
GAGCAGCAAGCAGGAGGTGACCCAGATCCCCGCCGCCCTGAGCGTGCCCG 100
AGGGCGAGAACCTGGTGCTGAACTGCAGCTTCACCGACAGCGCCATCTAC 150
AACCTGCAGTGGTTCCGCCAGGACCCCGGCAAGGGCCTGACCAGCCTGCT 200
GCTGATCCAGAGCAGCCAGCGCGAGCAGACCAGCGGCCGCCTGAACGCCA 250
GCCTGGACAAGAGCAGCGGCCGCAGCACCCTGTACATCGCCGCCAGCCAG 300
CCCGGCGACAGCGCCACCTACCTGTGCGCCGTGTACAGCGGCGCCGGCAG 350
CTACCAGCTGACCTTCGGCAAGGGCACCAAGCTGAGCGTGATCCCCAACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 493]

Beta chain:

ATGGGCCCCCAGCTGCTGGGCTACGTGGTGCTGTGCCTGCTGGGCGCCGG 50
CCCCCTGGAGGCCCAGGTGACCCAGAACCCCCGCTACCTGATCACCGTGA 100
CCGGCAAGAAGCTGACCGTGACCTGCAGCCAGAACATGAACCACGAGTAC 150
ATGAGCTGGTACCGCCAGGACCCCGGCCTGGGCCTGCGCCAGATCTACTA 200
CAGCATGAACGTGGAGGTGACCGACAAGGGCGACGTGCCCGAGGGCTACA 250
AGGTGAGCCGCAAGGAGAAGCGCAACTTCCCCCTGATCCTGGAGAGCCCC 300
AGCCCCAACCAGACCAGCCTGTACTTCTGCGCCAGCCGCACCGGCGGCGT 350
GAACGAGCAGTACTTCGGCCCCGGCACCCGCCTGACCGTGACCGAGGACC 400
TGAACAAGGTGTTCCCCCCCGAGGTGGCCGTGTTCGAGCCCAGCGAGGCC 450
GAGATCAGCCACACCCAGAAGGCCACCCTGGTGTGCCTGGCCACCGGCTT 500
CTTCCCCGACCACGTGGAGCTGAGCTGGTGGGTGAACGGCAAGGAGGTGC 550
ACAGCGGCGTGTGCACCGACCCCCAGCCCCTGAAGGAGCAGCCCGCCCTG 600
AACGACAGCCGCTACTGCCTGAGCAGCCGCCTGCGCGTGAGCGCCACCTT 650
CTGGCAGAACCCCCGCAACCACTTCCGCTGCCAGGTGCAGTTCTACGGCC 700
TGAGCGAGAACGACGAGTGGACCCAGGACCGCGCCAAGCCCGTGACCCAG 750
ATCGTGAGCGCCGAGGCCTGGGGCCGCGCCGACTGCGGCTTCACCAGCGT 800
GAGCTACCAGCAGGGCGTGCTGAGCGCCACCATCCTGTACGAGATCCTGC 850
TGGGCAAGGCCACCCTGTACGCCGTGCTGGTGAGCGCCCTGGTGCTGATG 900
GCCATGGTGAAGCGCAAGGACTTC [SEQ ID NO: 574]

FIG. 13

Donor B24 Clone 1 (IED)

Alpha chain:

ATGTGGGGCGTGTTCCTGCTGTACGTGAGCATGAAGATGGGCGGCACCAC 50
CGGCCAGAACATCGACCAGCCCACCGAGATGACCGCCACCGAGGGCGCCA 100
TCGTGCAGATCAACTGCACCTACCAGACCAGCGGCTTCAACGGCCTGTTC 150
TGGTACCAGCAGCACGCCGGCGAGGCCCCCACCTTCCTGAGCTACAACGT 200
GCTGGACGGCCTGGAGGAGAAGGGCCGCTTCAGCAGCTTCCTGAGCCGCA 250
GCAAGGGCTACAGCTACCTGCTGCTGAAGGAGCTGCAGATGAAGGACAGC 300
GCCAGCTACCTGTGCGCCGTGGGCGGCAACACCGGCGGCTTCAAGACCAT 350
CTTCGGCGCCGGCACCCGCCTGTTCGTGAAGGCCAACATCCAGAACCCCG 400
ACCCCGCCGTGTACCAGCTGCGCGACAGCAAGAGCAGCGACAAGAGCGTG 450
TGCCTGTTCACCGACTTCGACAGCCAGACCAACGTGAGCCAGAGCAAGGA 500
CAGCGACGTGTACATCACCGACAAGTGCGTGCTGGACATGCGCAGCATGG 550
ACTTCAAGAGCAACAGCGCCGTGGCCTGGAGCAACAAGAGCGACTTCGCC 600
TGCGCCAACGCCTTCAACAACAGCATCATCCCCGAGGACACCTTCTTCCC 650
CAGCCCCGAGAGCAGCTGCGACGTGAAGCTGGTGGAGAAGAGCTTCGAGA 700
CCGACACCAACCTGAACTTCCAGAACCTGAGCGTGATCGGCTTCCGCATC 750
CTGCTGCTGAAGGTGGCCGGCTTCAACCTGCTGATGACCCTGCGCCTGTG 800
GAGCAGC [SEQ ID NO: 494]

Beta chain:

ATGGGCTTCCGCCTGCTGTGCTGCGTGGCCTTCTGCCTGCTGGGCGCCGG 50
CCCCGTGGACAGCGGCGTGACCCAGACCCCCAAGCACCTGATCACCGCCA 100
CCGGCCAGCGCGTGACCCTGCGCTGCAGCCCCCGCAGCGGCGACCTGAGC 150
GTGTACTGGTACCAGCAGAGCCTGGACCAGGGCCTGCAGTTCCTGATCCA 200
GTACTACAACGGCGAGGAGCGCGCCAAGGGCAACATCCTGGAGCGCTTCA 250
GCGCCCAGCAGTTCCCCGACCTGCACAGCGAGCTGAACCTGAGCAGCCTG 300
GAGCTGGGCGACAGCGCCCTGTACTTCTGCGCCAGCAGCGCCGGCCAGGG 350
CCTGGCCGGCGACGAGCAGTTCTTCGGCCCCGGCACCCGCCTGACCGTGC 400
TGGAGGACCTGAACAAGGTGTTCCCCCCCGAGGTGGCCGTGTTCGAGCCC 450
AGCGAGGCCGAGATCAGCCACACCCAGAAGGCCACCCTGGTGTGCCTGGC 500
CACCGGCTTCTTCCCCGACCACGTGGAGCTGAGCTGGTGGGTGAACGGCA 550
AGGAGGTGCACAGCGGCGTGTGCACCGACCCCCAGCCCCTGAAGGAGCAG 600
CCCGCCCTGAACGACAGCCGCTACTGCCTGAGCAGCCGCCTGCGCGTGAG 650
CGCCACCTTCTGGCAGAACCCCCGCAACCACTTCCGCTGCCAGGTGCAGT 700
TCTACGGCCTGAGCGAGAACGACGAGTGGACCCAGGACCGCGCCAAGCCC 750
GTGACCCAGATCGTGAGCGCCGAGGCCTGGGGCCGCGCCGACTGCGGCTT 800
CACCAGCGTGAGCTACCAGCAGGGCGTGCTGAGCGCCACCATCCTGTACG 850
AGATCCTGCTGGGCAAGGCCACCCTGTACGCCGTGCTGGTGAGCGCCCTG 900
GTGCTGATGGCCATGGTGAAGCGCAAGGACTTC [SEQ ID NO: 575]

FIG. 14

Donor B24 Clone 2 (IED)

Alpha chain:

ATGCTGACCGCCAGCCTGCTGCGCGCCGTGATCGCCAGCATCTGCGTGGT 50
GAGCAGCATGGCCCAGAAGGTGACCCAGGCCCAGACCGAGATCAGCGTGG 100
TGGAGAAGGAGGACGTGACCCTGGACTGCGTGTACGAGACCCGCGACACC 150
ACCTACTACCTGTTCTGGTACAAGCAGCCCCCCAGCGGCGAGCTGGTGTT 200
CCTGATCCGCCGCAACAGCTTCGACGAGCAGAACGAGATCAGCGGCCGCT 250
ACAGCTGGAACTTCCAGAAGAGCACCAGCAGCTTCAACTTCACCATCACC 300
GCCAGCCAGGTGGTGGACAGCGCCGTGTACTTCTGCGCCCTGAGCGAGGC 350
CCGCGGCAGCCAGGGCAACCTGATCTTCGGCAAGGGCACCAAGCTGAGCG 400
TGAAGCCCAACATCCAGAACCCCGACCCCGCCGTGTACCAGCTGCGCGAC 450
AGCAAGAGCAGCGACAAGAGCGTGTGCCTGTTCACCGACTTCGACAGCCA 500
GACCAACGTGAGCCAGAGCAAGGACAGCGACGTGTACATCACCGACAAGT 550
GCGTGCTGGACATGCGCAGCATGGACTTCAAGAGCAACAGCGCCGTGGCC 600
TGGAGCAACAAGAGCGACTTCGCCTGCGCCAACGCCTTCAACAACAGCAT 650
CATCCCCGAGGACACCTTCTTCCCCAGCCCCGAGAGCAGCTGCGACGTGA 700
AGCTGGTGGAGAAGAGCTTCGAGACCGACACCAACCTGAACTTCCAGAAC 750
CTGAGCGTGATCGGCTTCCGCATCCTGCTGCTGAAGGTGGCCGGCTTCAA 800
CCTGCTGATGACCCTGCGCCTGTGGAGCAGC [SEQ ID NO: 495]

Beta chain:

ATGGGCTGCCGCCTGCTGTGCTGCGCCGTGCTGTGCCTGCTGGGCGCCGT 50
GCCCATCGACACCGAGGTGACCCAGACCCCCAAGCACCTGGTGATGGGCA 100
TGACCAACAAGAAGAGCCTGAAGTGCGAGCAGCACATGGGCCACCGCGCC 150
ATGTACTGGTACAAGCAGAAGGCCAAGAAGCCCCCCGAGCTGATGTTCGT 200
GTACAGCTACGAGAAGCTGAGCATCAACGAGAGCGTGCCCAGCCGCTTCA 250
GCCCCGAGTGCCCCAACAGCAGCCTGCTGAACCTGCACCTGCACGCCCTG 300
CAGCCCGAGGACAGCGCCCTGTACCTGTGCGCCAGCAGCCAGGAGGCCGC 350
CAGCGGCGGCCTGATCAACGAGCAGTTCTTCGGCCCCGGCACCCGCCTGA 400
CCGTGCTGGAGGACCTGAACAAGGTGTTCCCCCCCGAGGTGGCCGTGTTC 450
GAGCCCAGCGAGGCCGAGATCAGCCACACCCAGAAGGCCACCCTGGTGTG 500
CCTGGCCACCGGCTTCTTCCCCGACCACGTGGAGCTGAGCTGGTGGGTGA 550
ACGGCAAGGAGGTGCACAGCGGCGTGTGCACCGACCCCCAGCCCCTGAAG 600
GAGCAGCCCGCCCTGAACGACAGCCGCTACTGCCTGAGCAGCCGCCTGCG 650
CGTGAGCGCCACCTTCTGGCAGAACCCCCGCAACCACTTCCGCTGCCAGG 700
TGCAGTTCTACGGCCTGAGCGAGAACGACGAGTGGACCCAGGACCGCGCC 750
AAGCCCGTGACCCAGATCGTGAGCGCCGAGGCCTGGGGCCGCGCCGACTG 800
CGGCTTCACCAGCGTGAGCTACCAGCAGGGCGTGCTGAGCGCCACCATCC 850
TGTACGAGATCCTGCTGGGCAAGGCCACCCTGTACGCCGTGCTGGTGAGC 900
GCCCTGGTGCTGATGGCCATGGTGAAGCGCAAGGACTTC [SEQ ID NO: 576]

FIG. 15

Donor B24 Clone 3 (IED)

Alpha chain:

ATGAAGCTGGTGACCAGCATCACCGTGCTGCTGAGCCTGGGCATCATGGG 50
CGACGCCAAGACCACCCAGCCCAACAGCATGGAGAGCAACGAGGAGGAGC 100
CCGTGCACCTGCCCTGCAACCACAGCACCATCAGCGGCACCGACTACATC 150
CACTGGTACCGCCAGCTGCCCAGCCAGGGCCCCGAGTACGTGATCCACGG 200
CCTGACCAGCAACGTGAACAACCGCATGGCCAGCCTGGCCATCGCCGAGG 250
ACCGCAAGAGCAGCACCCTGATCCTGCACCGCGCCACCCTGCGCGACGCC 300
GCCGTGTACTACTGCATCCTGCGCGACGTGACCGGCGGCTTCAAGACCAT 350
CTTCGGCGCCGGCACCCGCCTGTTCGTGAAGGCCAACATCCAGAACCCCG 400
ACCCCGCCGTGTACCAGCTGCGCGACAGCAAGAGCAGCGACAAGAGCGTG 450
TGCCTGTTCACCGACTTCGACAGCCAGACCAACGTGAGCCAGAGCAAGGA 500
CAGCGACGTGTACATCACCGACAAGTGCGTGCTGGACATGCGCAGCATGG 550
ACTTCAAGAGCAACAGCGCCGTGGCCTGGAGCAACAAGAGCGACTTCGCC 600
TGCGCCAACGCCTTCAACAACAGCATCATCCCCGAGGACACCTTCTTCCC 650
CAGCCCCGAGAGCAGCTGCGACGTGAAGCTGGTGGAGAAGAGCTTCGAGA 700
CCGACACCAACCTGAACTTCCAGAACCTGAGCGTGATCGGCTTCCGCATC 750
CTGCTGCTGAAGGTGGCCGGCTTCAACCTGCTGATGACCCTGCGCCTGTG 800
GAGCAGC [SEQ ID NO:496]

Beta chain:

ATGGGCCCCCAGCTGCTGGGCTACGTGGTGCTGTGCCTGCTGGGCGCCGG 50
CCCCCTGGAGGCCCAGGTGACCCAGAACCCCCGCTACCTGATCACCGTGA 100
CCGGCAAGAAGCTGACCGTGACCTGCAGCCAGAACATGAACCACGAGTAC 150
ATGAGCTGGTACCGCCAGGACCCCGGCCTGGGCCTGCGCCAGATCTACTA 200
CAGCATGAACGTGGAGGTGACCGACAAGGGCGACGTGCCCGAGGGCTACA 250
AGGTGAGCCGCAAGGAGAAGCGCAACTTCCCCCTGATCCTGGAGAGCCCC 300
AGCCCCAACCAGACCAGCCTGTACTTCTGCGCCAGCAGCTACAGCGGCGG 350
CCCCCTGTACGAGCAGTACTTCGGCCCCGGCACCCGCCTGACCGTGACCG 400
AGGACCTGAACAAGGTGTTCCCCCCCGAGGTGGCCGTGTTCGAGCCCAGC 450
GAGGCCGAGATCAGCCACACCCAGAAGGCCACCCTGGTGTGCCTGGCCAC 500
CGGCTTCTTCCCCGACCACGTGGAGCTGAGCTGGTGGGTGAACGGCAAGG 550
AGGTGCACAGCGGCGTGTGCACCGACCCCCAGCCCCTGAAGGAGCAGCCC 600
GCCCTGAACGACAGCCGCTACTGCCTGAGCAGCCGCCTGCGCGTGAGCGC 650
CACCTTCTGGCAGAACCCCCGCAACCACTTCCGCTGCCAGGTGCAGTTCT 700
ACGGCCTGAGCGAGAACGACGAGTGGACCCAGGACCGCGCCAAGCCCGTG 750
ACCCAGATCGTGAGCGCCGAGGCCTGGGGCCGCGCCGACTGCGGCTTCAC 800
CAGCGTGAGCTACCAGCAGGGCGTGCTGAGCGCCACCATCCTGTACGAGA 850
TCCTGCTGGGCAAGGCCACCCTGTACGCCGTGCTGGTGAGCGCCCTGGTG 900
CTGATGGCCATGGTGAAGCGCAAGGACTTC [SEQ ID NO: 577]

FIG. 16

Donor B24 Clone 4 (IED)

Alpha chain:

ATGCTGCTGGAGCACCTGCTGATCATCCTGTGGATGCAGCTGACCTGGGT 50
GAGCGGCCAGCAGCTGAACCAGAGCCCCCAGAGCATGTTCATCCAGGAGG 100
GCGAGGACGTGAGCATGAACTGCACCAGCAGCAGCATCTTCAACACCTGG 150
CTGTGGTACAAGCAGGACCCCGGCGAGGGCCCCGTGCTGCTGATCGCCCT 200
GTACAAGGCCGGCGAGCTGACCAGCAACGGCCGCCTGACCGCCCAGTTCG 250
GCATCACCCGCAAGGACAGCTTCCTGAACATCAGCGCCAGCATCCCCAGC 300
GACGTGGGCATCTACTTCTGCGCCGGCCGCGGCAGCTACAACTTCAACAA 350
GTTCTACTTCGGCAGCGGCACCAAGCTGAACGTGAAGCCCAACATCCAGA 400
ACCCCGACCCCGCCGTGTACCAGCTGCGCGACAGCAAGAGCAGCGACAAG 450
AGCGTGTGCCTGTTCACCGACTTCGACAGCCAGACCAACGTGAGCCAGAG 500
CAAGGACAGCGACGTGTACATCACCGACAAGTGCGTGCTGGACATGCGCA 550
GCATGGACTTCAAGAGCAACAGCGCCGTGGCCTGGAGCAACAAGAGCGAC 600
TTCGCCTGCGCCAACGCCTTCAACAACAGCATCATCCCCGAGGACACCTT 650
CTTCCCCAGCCCCGAGAGCAGCTGCGACGTGAAGCTGGTGGAGAAGAGCT 700
TCGAGACCGACACCAACCTGAACTTCCAGAACCTGAGCGTGATCGGCTTC 750
CGCATCCTGCTGCTGAAGGTGGCCGGCTTCAACCTGCTGATGACCCTGCG 800
CCTGTGGAGCAGC [SEQ ID NO: 497]

Beta chain:

ATGGGCCCCCAGCTGCTGGGCTACGTGGTGCTGTGCCTGCTGGGCGCCGG 50
CCCCCTGGAGGCCCAGGTGACCCAGAACCCCCGCTACCTGATCACCGTGA 100
CCGGCAAGAAGCTGACCGTGACCTGCAGCCAGAACATGAACCACGAGTAC 150
ATGAGCTGGTACCGCCAGGACCCCGGCCTGGGCCTGCGCCAGATCTACTA 200
CAGCATGAACGTGGAGGTGACCGACAAGGGCGACGTGCCCGAGGGCTACA 250
AGGTGAGCCGCAAGGAGAAGCGCAACTTCCCCCTGATCCTGGAGAGCCCC 300
AGCCCCAACCAGACCAGCCTGTACTTCTGCGCCAGCAGCTACGCCGGCGG 350
CCCCCAGTACGGCTACACCTTCGGCAGCGGCACCCGCCTGACCGTGGTGG 400
AGGACCTGAACAAGGTGTTCCCCCCCGAGGTGGCCGTGTTCGAGCCCAGC 450
GAGGCCGAGATCAGCCACACCCAGAAGGCCACCCTGGTGTGCCTGGCCAC 500
CGGCTTCTTCCCCGACCACGTGGAGCTGAGCTGGTGGGTGAACGGCAAGG 550
AGGTGCACAGCGGCGTGTGCACCGACCCCCAGCCCCTGAAGGAGCAGCCC 600
GCCCTGAACGACAGCCGCTACTGCCTGAGCAGCCGCCTGCGCGTGAGCGC 650
CACCTTCTGGCAGAACCCCCGCAACCACTTCCGCTGCCAGGTGCAGTTCT 700
ACGGCCTGAGCGAGAACGACGAGTGGACCCAGGACCGCGCCAAGCCCGTG 750
ACCCAGATCGTGAGCGCCGAGGCCTGGGGCCGCGCCGACTGCGGCTTCAC 800
CAGCGTGAGCTACCAGCAGGGCGTGCTGAGCGCCACCATCCTGTACGAGA 850
TCCTGCTGGGCAAGGCCACCCTGTACGCCGTGCTGGTGAGCGCCCTGGTG 900
CTGATGGCCATGGTGAAGCGCAAGGACTTC [SEQ ID NO: 578]

FIG. 17

Donor A5L Clone 1 (IED)

Alpha chain:

```
ATGTGGGGCGCCTTCCTGCTGTACGTGAGCATGAAGATGGGCGGCACCGC      50
CGGCCAGAGCCTGGAGCAGCCCAGCGAGGTGACCGCCGTGGAGGGCGCCA      100
TCGTGCAGATCAACTGCACCTACCAGACCAGCGGCTTCTACGGCCTGAGC      150
TGGTACCAGCAGCACGACGGCGGCGCCCCCACCTTCCTGAGCTACAACGC      200
CCTGGACGGCCTGGAGGAGACCGGCCGCTTCAGCAGCTTCCTGAGCCGCA      250
GCGACAGCTACGGCTACCTGCTGCTGCAGGAGCTGCAGATGAAGGACAGC      300
GCCAGCTACTTCTGCGCCAGCAGCGAGGGCAAGCTGATCTTCGGCCAGGG      350
CACCGAGCTGAGCGTGAAGCCCAACATCCAGAACCCCGACCCCGCCGTGT      400
ACCAGCTGCGCGACAGCAAGAGCAGCGACAAGAGCGTGTGCCTGTTCACC      450
GACTTCGACAGCCAGACCAACGTGAGCCAGAGCAAGGACAGCGACGTGTA      500
CATCACCGACAAGTGCGTGCTGGACATGCGCAGCATGGACTTCAAGAGCA      550
ACAGCGCCGTGGCCTGGAGCAACAAGAGCGACTTCGCCTGCGCCAACGCC      600
TTCAACAACAGCATCATCCCCGAGGACACCTTCTTCCCCAGCCCCGAGAG      650
CAGCTGCGACGTGAAGCTGGTGGAGAAGAGCTTCGAGACCGACACCAACC      700
TGAACTTCCAGAACCTGAGCGTGATCGGCTTCCGCATCCTGCTGCTGAAG      750
GTGGCCGGCTTCAACCTGCTGATGACCCTGCGCCTGTGGAGCAGC [SEQ ID NO: 498]
```

Beta chain:

```
ATGCTGCTGCTGCTGCTGCTGCTGGGCCCCGGCATCAGCCTGCTGCTGCC      50
CGGCAGCCTGGCCGGCAGCGGCCTGGGCGCCGTGGTGAGCCAGCACCCCA      100
GCTGGGTGATCTGCAAGAGCGGCACCAGCGTGAAGATCGAGTGCCGCAGC      150
CTGGACTTCCAGGCCACCACCATGTTCTGGTACCGCCAGTTCCCCAAGCA      200
GAGCCTGATGCTGATGGCCACCAGCAACGAGGGCAGCAAGGCCACCTACG      250
AGCAGGGCGTGGAGAAGGACAAGTTCCTGATCAACCACGCCAGCCTGACC      300
CTGAGCACCCTGACCGTGACCAGCGCCCACCCCGAGGACAGCAGCTTCTA      350
CATCTGCAGCGCCCGCGACGGCAGCCCCATCGCCGGCGGCCTGAACGAGC      400
AGTTCTTCGGCCCCGGCACCCGCCTGACCGTGCTGGAGGACCTGAACAAG      450
GTGTTCCCCCCCGAGGTGGCCGTGTTCGAGCCCAGCGAGGCCGAGATCAG      500
CCACACCCAGAAGGCCACCCTGGTGTGCCTGGCCACCGGCTTCTTCCCCG      550
ACCACGTGGAGCTGAGCTGGTGGGTGAACGGCAAGGAGGTGCACAGCGGC      600
GTGTGCACCGACCCCCAGCCCCTGAAGGAGCAGCCCGCCCTGAACGACAG      650
CCGCTACTGCCTGAGCAGCCGCCTGCGCGTGAGCGCCACCTTCTGGCAGA      700
ACCCCCGCAACCACTTCCGCTGCCAGGTGCAGTTCTACGGCCTGAGCGAG      750
AACGACGAGTGGACCCAGGACCGCGCCAAGCCCGTGACCCAGATCGTGAG      800
CGCCGAGGCCTGGGGCCGCGCCGACTGCGGCTTCACCAGCGTGAGCTACC      850
AGCAGGGCGTGCTGAGCGCCACCATCCTGTACGAGATCCTGCTGGGCAAG      900
GCCACCCTGTACGCCGTGCTGGTGAGCGCCCTGGTGCTGATGGCCATGGT      950
GAAGCGCAAGGACTTC [SEQ ID NO: 579]
```

FIG. 18

Donor A5L Clone 2 (IED)

Alpha chain:

ATGAAGCCCACCCTGATCAGCGTGCTGGTGATCATCTTCATCCTGCGCGG 50
CACCCGCGCCCAGCGCGTGACCCAGCCCGAGAAGCTGCTGAGCGTGTTCA 100
AGGGCGCCCCCGTGGAGCTGAAGTGCAACTACAGCTACAGCGGCAGCCCC 150
GAGCTGTTCTGGTACGTGCAGTACAGCCGCCAGCGCCTGCAGCTGCTGCT 200
GCGCCACATCAGCCGCGAGAGCATCAAGGGCTTCACCGCCGACCTGAACA 250
AGGGCGAGACCAGCTTCCACCTGAAGAAGCCCTTCGCCCAGGAGGAGGAC 300
AGCGCCATGTACTACTGCGCCCTGCGCTGGCAGACCGGCGCCAACAACCT 350
GTTCTTCGGCACCGGCACCCGCCTGACCGTGATCCCCTACATCCAGAACC 400
CCGACCCCGCCGTGTACCAGCTGCGCGACAGCAAGAGCAGCGACAAGAGC 450
GTGTGCCTGTTCACCGACTTCGACAGCCAGACCAACGTGAGCCAGAGCAA 500
GGACAGCGACGTGTACATCACCGACAAGTGCGTGCTGGACATGCGCAGCA 550
TGGACTTCAAGAGCAACAGCGCCGTGGCCTGGAGCAACAAGAGCGACTTC 600
GCCTGCGCCAACGCCTTCAACAACAGCATCATCCCCGAGGACACCTTCTT 650
CCCCAGCCCCGAGAGCAGCTGCGACGTGAAGCTGGTGGAGAAGAGCTTCG 700
AGACCGACACCAACCTGAACTTCCAGAACCTGAGCGTGATCGGCTTCCGC 750
ATCCTGCTGCTGAAGGTGGCCGGCTTCAACCTGCTGATGACCCTGCGCCT 800
GTGGAGCAGC [SEQ ID NO:499]

Beta chain:

ATGGGCCCCCAGCTGCTGGGCTACGTGGTGCTGTGCCTGCTGGGCGCCGG 50
CCCCCTGGAGGCCCAGGTGACCCAGAACCCCCGCTACCTGATCACCGTGA 100
CCGGCAAGAAGCTGACCGTGACCTGCAGCCAGAACATGAACCACGAGTAC 150
ATGAGCTGGTACCGCCAGGACCCCGGCCTGGGCCTGCGCCAGATCTACTA 200
CAGCATGAACGTGGAGGTGACCGACAAGGGCGACGTGCCCGAGGGCTACA 250
AGGTGAGCCGCAAGGAGAAGCGCAACTTCCCCCTGATCCTGGAGAGCCCC 300
AGCCCCAACCAGACCAGCCTGTACTTCTGCGCCAGCAGCTACAGCGGCGG 350
CCCCCTGTACGAGCAGTACTTCGGCCCCGGCACCCGCCTGACCGTGACCG 400
AGGACCTGAACAAGGTGTTCCCCCCCGAGGTGGCCGTGTTCGAGCCCAGC 450
GAGGCCGAGATCAGCCACACCCAGAAGGCCACCCTGGTGTGCCTGGCCAC 500
CGGCTTCTTCCCCGACCACGTGGAGCTGAGCTGGTGGGTGAACGGCAAGG 550
AGGTGCACAGCGGCGTGTGCACCGACCCCCAGCCCCTGAAGGAGCAGCCC 600
GCCCTGAACGACAGCCGCTACTGCCTGAGCAGCCGCCTGCGCGTGAGCGC 650
CACCTTCTGGCAGAACCCCCGCAACCACTTCCGCTGCCAGGTGCAGTTCT 700
ACGGCCTGAGCGAGAACGACGAGTGGACCCAGGACCGCGCCAAGCCCGTG 750
ACCCAGATCGTGAGCGCCGAGGCCTGGGGCCGCGCCGACTGCGGCTTCAC 800
CAGCGTGAGCTACCAGCAGGGCGTGCTGAGCGCCACCATCCTGTACGAGA 850
TCCTGCTGGGCAAGGCCACCCTGTACGCCGTGCTGGTGAGCGCCCTGGTG 900
CTGATGGCCATGGTGAAGCGCAAGGACTTC [SEQ ID NO: 580]

FIG. 19

Donor A5L Clone 3 (IED)

Alpha chain:
ATGTGGGGCGTGTTCCTGCTGTACGTGAGCATGAAGATGGGCGGCACCAC 50
CGGCCAGAACATCGACCAGCCCACCGAGATGACCGCCACCGAGGGCGCCA 100
TCGTGCAGATCAACTGCACCTACCAGACCAGCGGCTTCAACGGCCTGTTC 150
TGGTACCAGCAGCACGCCGGCGAGGCCCCCACCTTCCTGAGCTACAACGT 200
GCTGGACGGCCTGGAGGAGAAGGGCCGCTTCAGCAGCTTCCTGAGCCGCA 250
GCAAGGGCTACAGCTACCTGCTGCTGAAGGAGCTGCAGATGAAGGACAGC 300
GCCAGCTACCTGTGCGCCGTGAACGGCGGCACCGGCGGCTTCAAGACCAT 350
CTTCGGCGCCGGCACCCGCCTGTTCGTGAAGGCCAACATCCAGAACCCCG 400
ACCCCGCCGTGTACCAGCTGCGCGACAGCAAGAGCAGCGACAAGAGCGTG 450
TGCCTGTTCACCGACTTCGACAGCCAGACCAACGTGAGCCAGAGCAAGGA 500
CAGCGACGTGTACATCACCGACAAGTGCGTGCTGGACATGCGCAGCATGG 550
ACTTCAAGAGCAACAGCGCCGTGGCCTGGAGCAACAAGAGCGACTTCGCC 600
TGCGCCAACGCCTTCAACAACAGCATCATCCCCGAGGACACCTTCTTCCC 650
CAGCCCCGAGAGCAGCTGCGACGTGAAGCTGGTGGAGAAGAGCTTCGAGA 700
CCGACACCAACCTGAACTTCCAGAACCTGAGCGTGATCGGCTTCCGCATC 750
CTGCTGCTGAAGGTGGCCGGCTTCAACCTGCTGATGACCCTGCGCCTGTG 800
GAGCAGC [SEQ ID NO: 500]

Beta chain:
ATGGGCTTCCGCCTGCTGTGCTGCGTGGCCTTCTGCCTGCTGGGCGCCGG 50
CCCCGTGGACAGCGGCGTGACCCAGACCCCCAAGCACCTGATCACCGCCA 100
CCGGCCAGCGCGTGACCCTGCGCTGCAGCCCCCGCAGCGGCGACCTGAGC 150
GTGTACTGGTACCAGCAGAGCCTGGACCAGGGCCTGCAGTTCCTGATCCA 200
GTACTACAACGGCGAGGAGCGCGCCAAGGGCAACATCCTGGAGCGCTTCA 250
GCGCCCAGCAGTTCCCCGACCTGCACAGCGAGCTGAACCTGAGCAGCCTG 300
GAGCTGGGCGACAGCGCCCTGTACTTCTGCGCCAGCAGCGTGGGCGAGGG 350
CCTGGCCGGCGACACCCAGTACTTCGGCCCCGGCACCCGCCTGACCGTGC 400
TGGAGGACCTGAACAAGGTGTTCCCCCCCGAGGTGGCCGTGTTCGAGCCC 450
AGCGAGGCCGAGATCAGCCACACCCAGAAGGCCACCCTGGTGTGCCTGGC 500
CACCGGCTTCTTCCCCGACCACGTGGAGCTGAGCTGGTGGGTGAACGGCA 550
AGGAGGTGCACAGCGGCGTGTGCACCGACCCCCAGCCCCTGAAGGAGCAG 600
CCCGCCCTGAACGACAGCCGCTACTGCCTGAGCAGCCGCCTGCGCGTGAG 650
CGCCACCTTCTGGCAGAACCCCCGCAACCACTTCCGCTGCCAGGTGCAGT 700
TCTACGGCCTGAGCGAGAACGACGAGTGGACCCAGGACCGCGCCAAGCCC 750
GTGACCCAGATCGTGAGCGCCGAGGCCTGGGGCCGCGCCGACTGCGGCTT 800
CACCAGCGTGAGCTACCAGCAGGGCGTGCTGAGCGCCACCATCCTGTACG 850
AGATCCTGCTGGGCAAGGCCACCCTGTACGCCGTGCTGGTGAGCGCCCTG 900
GTGCTGATGGCCATGGTGAAGCGCAAGGACTTC [SEQ ID NO: 581]

FIG. 20

Donor A5L Clone 4 (IED)

Alpha chain:
ATGGAGAAGAACCCCCTGGCCGCCCCCCTGCTGATCCTGTGGTTCCACCT 50
GGACTGCGTGAGCAGCATCCTGAACGTGGAGCAGAGCCCCCAGAGCCTGC 100
ACGTGCAGGAGGGCGACAGCACCAACTTCACCTGCAGCTTCCCCAGCAGC 150
AACTTCTACGCCCTGCACTGGTACCGCTGGGAGACCGCCAAGAGCCCCGA 200
GGCCCTGTTCGTGATGACCCTGAACGGCGACGAGAAGAAGAAGGGCCGCA 250
TCAGCGCCACCCTGAACACCAAGGAGGGCTACAGCTACCTGTACATCAAG 300
GGCAGCCAGCCCGAGGACAGCGCCACCTACCTGTGCGCCAGCCCCCGCAC 350
CGGCTTCCAGAAGCTGGTGTTCGGCACCGGCACCCGCCTGCTGGTGAGCC 400
CCAACATCCAGAACCCCGACCCCGCCGTGTACCAGCTGCGCGACAGCAAG 450
AGCAGCGACAAGAGCGTGTGCCTGTTCACCGACTTCGACAGCCAGACCAA 500
CGTGAGCCAGAGCAAGGACAGCGACGTGTACATCACCGACAAGTGCGTGC 550
TGGACATGCGCAGCATGGACTTCAAGAGCAACAGCGCCGTGGCCTGGAGC 600
AACAAGAGCGACTTCGCCTGCGCCAACGCCTTCAACAACAGCATCATCCC 650
CGAGGACACCTTCTTCCCCAGCCCCGAGAGCAGCTGCGACGTGAAGCTGG 700
TGGAGAAGAGCTTCGAGACCGACACCAACCTGAACTTCCAGAACCTGAGC 750
GTGATCGGCTTCCGCATCCTGCTGCTGAAGGTGGCCGGCTTCAACCTGCT 800
GATGACCCTGCGCCTGTGGAGCAGC [SEQ ID NO: 501]

Beta chain:
ATGGGCCCCCAGCTGCTGGGCTACGTGGTGCTGTGCCTGCTGGGCGCCGG 50
CCCCCTGGAGGCCCAGGTGACCCAGAACCCCCGCTACCTGATCACCGTGA 100
CCGGCAAGAAGCTGACCGTGACCTGCAGCCAGAACATGAACCACGAGTAC 150
ATGAGCTGGTACCGCCAGGACCCCGGCCTGGGCCTGCGCCAGATCTACTA 200
CAGCATGAACGTGGAGGTGACCGACAAGGGCGACGTGCCCGAGGGCTACA 250
AGGTGAGCCGCAAGGAGAAGCGCAACTTCCCCCTGATCCTGGAGAGCCCC 300
AGCCCCAACCAGACCAGCCTGTACTTCTGCGCCAGCCGCTACAGCGGCGG 350
CCCCCTGTACGAGCAGTTCTTCGGCCCCGGCACCCGCCTGACCGTGCTGG 400
AGGACCTGAACAAGGTGTTCCCCCCCGAGGTGGCCGTGTTCGAGCCCAGC 450
GAGGCCGAGATCAGCCACACCCAGAAGGCCACCCTGGTGTGCCTGGCCAC 500
CGGCTTCTTCCCCGACCACGTGGAGCTGAGCTGGTGGGTGAACGGCAAGG 550
AGGTGCACAGCGGCGTGTGCACCGACCCCCAGCCCCTGAAGGAGCAGCCC 600
GCCCTGAACGACAGCCGCTACTGCCTGAGCAGCCGCCTGCGCGTGAGCGC 650
CACCTTCTGGCAGAACCCCCGCAACCACTTCCGCTGCCAGGTGCAGTTCT 700
ACGGCCTGAGCGAGAACGACGAGTGGACCCAGGACCGCGCCAAGCCCGTG 750
ACCCAGATCGTGAGCGCCGAGGCCTGGGGCCGCGCCGACTGCGGCTTCAC 800
CAGCGTGAGCTACCAGCAGGGCGTGCTGAGCGCCACCATCCTGTACGAGA 850
TCCTGCTGGGCAAGGCCACCCTGTACGCCGTGCTGGTGAGCGCCCTGGTG 900
CTGATGGCCATGGTGAAGCGCAAGGACTTC [SEQ ID NO: 582]

FIG. 21

Donor A5L Clone 5 (IED)

Alpha chain:

ATGTGGGGCGCCTTCCTGCTGTACGTGAGCATGAAGATGGGCGGCACCGC 50
CGGCCAGAGCCTGGAGCAGCCCAGCGAGGTGACCGCCGTGGAGGGCGCCA 100
TCGTGCAGATCAACTGCACCTACCAGACCAGCGGCTTCTACGGCCTGAGC 150
TGGTACCAGCAGCACGACGGCGGCGCCCCCACCTTCCTGAGCTACAACGC 200
CCTGGACGGCCTGGAGGAGACCGGCCGCTTCAGCAGCTTCCTGAGCCGCA 250
GCGACAGCTACGGCTACCTGCTGCTGCAGGAGCTGCAGATGAAGGACAGC 300
GCCAGCTACTTCTGCGCCAGCACCGAGGGCAAGCTGATCTTCGGCCAGGG 350
CACCGAGCTGAGCGTGAAGCCCAACATCCAGAACCCCGACCCCGCCGTGT 400
ACCAGCTGCGCGACAGCAAGAGCAGCGACAAGAGCGTGTGCCTGTTCACC 450
GACTTCGACAGCCAGACCAACGTGAGCCAGAGCAAGGACAGCGACGTGTA 500
CATCACCGACAAGTGCGTGCTGGACATGCGCAGCATGGACTTCAAGAGCA 550
ACAGCGCCGTGGCCTGGAGCAACAAGAGCGACTTCGCCTGCGCCAACGCC 600
TTCAACAACAGCATCATCCCCGAGGACACCTTCTTCCCCAGCCCCGAGAG 650
CAGCTGCGACGTGAAGCTGGTGGAGAAGAGCTTCGAGACCGACACCAACC 700
TGAACTTCCAGAACCTGAGCGTGATCGGCTTCCGCATCCTGCTGCTGAAG 750
GTGGCCGGCTTCAACCTGCTGATGACCCTGCGCCTGTGGAGCAGC [SEQ ID NO: 502]

Beta chain:

ATGCTGCTGCTGCTGCTGCTGCTGGGCCCCGGCATCAGCCTGCTGCTGCC 50
CGGCAGCCTGGCCGGCAGCGGCCTGGGCGCCGTGGTGAGCCAGCACCCCA 100
GCTGGGTGATCTGCAAGAGCGGCACCAGCGTGAAGATCGAGTGCCGCAGC 150
CTGGACTTCCAGGCCACCACCATGTTCTGGTACCGCCAGTTCCCCAAGCA 200
GAGCCTGATGCTGATGGCCACCAGCAACGAGGGCAGCAAGGCCACCTACG 250
AGCAGGGCGTGGAGAAGGACAAGTTCCTGATCAACCACGCCAGCCTGACC 300
CTGAGCACCCTGACCGTGACCAGCGCCCACCCCGAGGACAGCAGCTTCTA 350
CATCTGCAGCGCCCGCGACGGCAGCCCCATCGCCGGCGGCCTGAACGAGC 400
AGTTCTTCGGCCCCGGCACCCGCCTGACCGTGCTGGAGGACCTGAACAAG 450
GTGTTCCCCCCCGAGGTGGCCGTGTTCGAGCCCAGCGAGGCCGAGATCAG 500
CCACACCCAGAAGGCCACCCTGGTGTGCCTGGCCACCGGCTTCTTCCCCG 550
ACCACGTGGAGCTGAGCTGGTGGGTGAACGGCAAGGAGGTGCACAGCGGC 600
GTGTGCACCGACCCCCAGCCCCTGAAGGAGCAGCCCGCCCTGAACGACAG 650
CCGCTACTGCCTGAGCAGCCGCCTGCGCGTGAGCGCCACCTTCTGGCAGA 700
ACCCCCGCAACCACTTCCGCTGCCAGGTGCAGTTCTACGGCCTGAGCGAG 750
AACGACGAGTGGACCCAGGACCGCGCCAAGCCCGTGACCCAGATCGTGAG 800
CGCCGAGGCCTGGGGCCGCGCCGACTGCGGCTTCACCAGCGTGAGCTACC 850
AGCAGGGCGTGCTGAGCGCCACCATCCTGTACGAGATCCTGCTGGGCAAG 900
GCCACCCTGTACGCCGTGCTGGTGAGCGCCCTGGTGCTGATGGCCATGGT 950
GAAGCGCAAGGACTTC [SEQ ID NO: 583]

FIG. 22

Donor B31 Clone 1 (IED)

Alpha chain:

ATGACCCGCGTGAGCCTGCTGTGGGCCGTGGTGGTGAGCACCTGCCTGGA 50
GAGCGGCATGGCCCAGACCGTGACCCAGAGCCAGCCCGAGATGAGCGTGC 100
AGGAGGCCGAGACCGTGACCCTGAGCTGCACCTACGACACCAGCGAGAAC 150
AACTACTACCTGTTCTGGTACAAGCAGCCCCCCAGCCGCCAGATGATCCT 200
GGTGATCCGCCAGGAGGCCTACAAGCAGCAGAACGCCACCGAGAACCGCT 250
TCAGCGTGAACTTCCAGAAGGCCGCCAAGAGCTTCAGCCTGAAGATCAGC 300
GACAGCCAGCTGGGCGACACCGCCATGTACTTCTGCGCCTTCATGACCGT 350
GTACAACCAGGGCGGCAAGCTGATCTTCGGCCAGGGCACCGAGCTGAGCG 400
TGAAGCCCAACATCCAGAACCCCGACCCCGCCGTGTACCAGCTGCGCGAC 450
AGCAAGAGCAGCGACAAGAGCGTGTGCCTGTTCACCGACTTCGACAGCCA 500
GACCAACGTGAGCCAGAGCAAGGACAGCGACGTGTACATCACCGACAAGT 550
GCGTGCTGGACATGCGCAGCATGGACTTCAAGAGCAACAGCGCCGTGGCC 600
TGGAGCAACAAGAGCGACTTCGCCTGCGCCAACGCCTTCAACAACAGCAT 650
CATCCCCGAGGACACCTTCTTCCCCAGCCCCGAGAGCAGCTGCGACGTGA 700
AGCTGGTGGAGAAGAGCTTCGAGACCGACACCAACCTGAACTTCCAGAAC 750
CTGAGCGTGATCGGCTTCCGCATCCTGCTGCTGAAGGTGGCCGGCTTCAA 800
CCTGCTGATGACCCTGCGCCTGTGGAGCAGC [SEQ ID NO: 503]

Beta chain:

ATGGGCTGCCGCCTGCTGTGCTGCGCCGTGCTGTGCCTGCTGGGCGCCGT 50
GCCCATCGACACCGAGGTGACCCAGACCCCCAAGCACCTGGTGATGGGCA 100
TGACCAACAAGAAGAGCCTGAAGTGCGAGCAGCACATGGGCCACCGCGCC 150
ATGTACTGGTACAAGCAGAAGGCCAAGAAGCCCCCCGAGCTGATGTTCGT 200
GTACAGCTACGAGAAGCTGAGCATCAACGAGAGCGTGCCCAGCCGCTTCA 250
GCCCCGAGTGCCCCAACAGCAGCCTGCTGAACCTGCACCTGCACGCCCTG 300
CAGCCCGAGGACAGCGCCCTGTACCTGTGCGCCAGCAGCCAGGAGGCCGG 350
CCGCCAGAACACCCAGTACTTCGGCCCCGGCACCCGCCTGACCGTGCTGG 400
AGGACCTGAACAAGGTGTTCCCCCCCGAGGTGGCCGTGTTCGAGCCCAGC 450
GAGGCCGAGATCAGCCACACCCAGAAGGCCACCCTGGTGTGCCTGGCCAC 500
CGGCTTCTTCCCCGACCACGTGGAGCTGAGCTGGTGGGTGAACGGCAAGG 550
AGGTGCACAGCGGCGTGTGCACCGACCCCCAGCCCCTGAAGGAGCAGCCC 600
GCCCTGAACGACAGCCGCTACTGCCTGAGCAGCCGCCTGCGCGTGAGCGC 650
CACCTTCTGGCAGAACCCCCGCAACCACTTCCGCTGCCAGGTGCAGTTCT 700
ACGGCCTGAGCGAGAACGACGAGTGGACCCAGGACCGCGCCAAGCCCGTG 750
ACCCAGATCGTGAGCGCCGAGGCCTGGGGCCGCGCCGACTGCGGCTTCAC 800
CAGCGTGAGCTACCAGCAGGGCGTGCTGAGCGCCACCATCCTGTACGAGA 850
TCCTGCTGGGCAAGGCCACCCTGTACGCCGTGCTGGTGAGCGCCCTGGTG 900
CTGATGGCCATGGTGAAGCGCAAGGACTTC [SEQ ID NO: 584]

FIG. 23

Donor B31 Clone 2 (IED)

Alpha chain:

ATGGAGACCCTGCTGGGCCTGCTGATCCTGTGGCTGCAGCTGCAGTGGGT 50
GAGCAGCAAGCAGGAGGTGACCCAGATCCCCGCCGCCCTGAGCGTGCCCG 100
AGGGCGAGAACCTGGTGCTGAACTGCAGCTTCACCGACAGCGCCATCTAC 150
AACCTGCAGTGGTTCCGCCAGGACCCCGGCAAGGGCCTGACCAGCCTGCT 200
GCTGATCCAGAGCAGCCAGCGCGAGCAGACCAGCGGCCGCCTGAACGCCA 250
GCCTGGACAAGAGCAGCGGCCGCAGCACCCTGTACATCGCCGCCAGCCAG 300
CCCGGCGACAGCGCCACCTACCTGTGCGCCCCCTACAGCGGCGCCGGCGC 350
CTACCAGCTGACCTTCGGCAAGGGCACCAAGCTGAGCGTGATCCCCAACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 504]

Beta chain:

ATGGGCCCCCAGCTGCTGGGCTACGTGGTGCTGTGCCTGCTGGGCGCCGG 50
CCCCCTGGAGGCCCAGGTGACCCAGAACCCCCGCTACCTGATCACCGTGA 100
CCGGCAAGAAGCTGACCGTGACCTGCAGCCAGAACATGAACCACGAGTAC 150
ATGAGCTGGTACCGCCAGGACCCCGGCCTGGGCCTGCGCCAGATCTACTA 200
CAGCATGAACGTGGAGGTGACCGACAAGGGCGACGTGCCCGAGGGCTACA 250
AGGTGAGCCGCAAGGAGAAGCGCAACTTCCCCCTGATCCTGGAGAGCCCC 300
AGCCCCAACCAGACCAGCCTGTACTTCTGCGCCACCCGCACCGGCGCCGT 350
GAACGAGCAGTTCTTCGGCCCCGGCACCCGCCTGACCGTGCTGGAGGACC 400
TGAACAAGGTGTTCCCCCCCGAGGTGGCCGTGTTCGAGCCCAGCGAGGCC 450
GAGATCAGCCACACCCAGAAGGCCACCCTGGTGTGCCTGGCCACCGGCTT 500
CTTCCCCGACCACGTGGAGCTGAGCTGGTGGGTGAACGGCAAGGAGGTGC 550
ACAGCGGCGTGTGCACCGACCCCCAGCCCCTGAAGGAGCAGCCCGCCCTG 600
AACGACAGCCGCTACTGCCTGAGCAGCCGCCTGCGCGTGAGCGCCACCTT 650
CTGGCAGAACCCCCGCAACCACTTCCGCTGCCAGGTGCAGTTCTACGGCC 700
TGAGCGAGAACGACGAGTGGACCCAGGACCGCGCCAAGCCCGTGACCCAG 750
ATCGTGAGCGCCGAGGCCTGGGGCCGCGCCGACTGCGGCTTCACCAGCGT 800
GAGCTACCAGCAGGGCGTGCTGAGCGCCACCATCCTGTACGAGATCCTGC 850
TGGGCAAGGCCACCCTGTACGCCGTGCTGGTGAGCGCCCTGGTGCTGATG 900
GCCATGGTGAAGCGCAAGGACTTC [SEQ ID NO: 585]

FIG. 24

TCRs specific for HLA-A*11:01-SSCSSCPLSK

Donor R7Z Clone 1 (SSC)

Alpha chain:

ATGGAGACCCTGCTGGGCCTGCTGATCCTGTGGCTGCAGCTGCAGTGGGT 50
GAGCAGCAAGCAGGAGGTGACCCAGATCCCCGCCGCCCTGAGCGTGCCCG 100
AGGGCGAGAACCTGGTGCTGAACTGCAGCTTCACCGACAGCGCCATCTAC 150
AACCTGCAGTGGTTCCGCCAGGACCCCGGCAAGGGCCTGACCAGCCTGCT 200
GCTGATCCAGAGCAGCCAGCGCGAGCAGACCAGCGGCCGCCTGAACGCCA 250
GCCTGGACAAGAGCAGCGGCCGCAGCACCCTGTACATCGCCGCCAGCCAG 300
CCCGGCGACAGCGCCACCTACCTGTGCGCCGTGTGGGCCGGCGGCACCAG 350
CTACGGCAAGCTGACCTTCGGCCAGGGCACCATCCTGACCGTGCACCCCA 400
ACATCCAGAACCCCGACCCCGCCGTGTACCAGCTGCGCGACAGCAAGAGC 450
AGCGACAAGAGCGTGTGCCTGTTCACCGACTTCGACAGCCAGACCAACGT 500
GAGCCAGAGCAAGGACAGCGACGTGTACATCACCGACAAGTGCGTGCTGG 550
ACATGCGCAGCATGGACTTCAAGAGCAACAGCGCCGTGGCCTGGAGCAAC 600
AAGAGCGACTTCGCCTGCGCCAACGCCTTCAACAACAGCATCATCCCCGA 650
GGACACCTTCTTCCCCAGCCCCGAGAGCAGCTGCGACGTGAAGCTGGTGG 700
AGAAGAGCTTCGAGACCGACACCAACCTGAACTTCCAGAACCTGAGCGTG 750
ATCGGCTTCCGCATCCTGCTGCTGAAGGTGGCCGGCTTCAACCTGCTGAT 800
GACCCTGCGCCTGTGGAGCAGC [SEQ ID NO: 505]

Beta chain:

ATGGGCATCCGCCTGCTGTGCCGCGTGGCCTTCTGCTTCCTGGCCGTGGG 50
CCTGGTGGACGTGAAGGTGACCCAGAGCAGCCGCTACCTGGTGAAGCGCA 100
CCGGCGAGAAGGTGTTCCTGGAGTGCGTGCAGGACATGGACCACGAGAAC 150
ATGTTCTGGTACCGCCAGGACCCCGGCCTGGGCCTGCGCCTGATCTACTT 200
CAGCTACGACGTGAAGATGAAGGAGAAGGGCGACATCCCCGAGGGCTACA 250
GCGTGAGCCGCGAGAAGAAGGAGCGCTTCAGCCTGATCCTGGAGAGCGCC 300
AGCACCAACCAGACCAGCATGTACCTGTGCGCCAGCAGCCCCGCCGGCCG 350
CCCCGGCAAGCCCCTGCACTTCGGCAACGGCACCCGCCTGACCGTGACCG 400
AGGACCTGAACAAGGTGTTCCCCCCCGAGGTGGCCGTGTTCGAGCCCAGC 450
GAGGCCGAGATCAGCCACACCCAGAAGGCCACCCTGGTGTGCCTGGCCAC 500
CGGCTTCTTCCCCGACCACGTGGAGCTGAGCTGGTGGGTGAACGGCAAGG 550
AGGTGCACAGCGGCGTGTGCACCGACCCCCAGCCCCTGAAGGAGCAGCCC 600
GCCCTGAACGACAGCCGCTACTGCCTGAGCAGCCGCCTGCGCGTGAGCGC 650
CACCTTCTGGCAGAACCCCCGCAACCACTTCCGCTGCCAGGTGCAGTTCT 700
ACGGCCTGAGCGAGAACGACGAGTGGACCCAGGACCGCGCCAAGCCCGTG 750
ACCCAGATCGTGAGCGCCGAGGCCTGGGGCCGCGCCGACTGCGGCTTCAC 800
CAGCGTGAGCTACCAGCAGGGCGTGCTGAGCGCCACCATCCTGTACGAGA 850
TCCTGCTGGGCAAGGCCACCCTGTACGCCGTGCTGGTGAGCGCCCTGGTG 900
CTGATGGCCATGGTGAAGCGCAAGGACTTC [SEQ ID NO: 586]

FIG. 25

Donor R7Z Clone 2 (SSC)

Alpha chain:

ATGAAGCGCATCCTGGGCGCCCTGCTGGGCCTGCTGAGCGCCCAGGTGTG 50
CTGCGTGCGCGGCATCCAGGTGGAGCAGAGCCCCCCCGACCTGATCCTGC 100
AGGAGGGCGCCAACAGCACCCTGCGCTGCAACTTCAGCGACAGCGTGAAC 150
AACCTGCAGTGGTTCCACCAGAACCCCTGGGGCCAGCTGATCAACCTGTT 200
CTACATCCCCAGCGGCACCAAGCAGAACGGCCGCCTGAGCGCCACCACCG 250
TGGCCACCGAGCGCTACAGCCTGCTGTACATCAGCAGCAGCCAGACCACC 300
GACAGCGGCGTGTACTTCTGCGCCGTGGTGATCAACAACGACATGCGCTT 350
CGGCGCCGGCACCCGCCTGACCGTGAAGCCCAACATCCAGAACCCCGACC 400
CCGCCGTGTACCAGCTGCGCGACAGCAAGAGCAGCGACAAGAGCGTGTGC 450
CTGTTCACCGACTTCGACAGCCAGACCAACGTGAGCCAGAGCAAGGACAG 500
CGACGTGTACATCACCGACAAGTGCGTGCTGGACATGCGCAGCATGGACT 550
TCAAGAGCAACAGCGCCGTGGCCTGGAGCAACAAGAGCGACTTCGCCTGC 600
GCCAACGCCTTCAACAACAGCATCATCCCCGAGGACACCTTCTTCCCCAG 650
CCCCGAGAGCAGCTGCGACGTGAAGCTGGTGGAGAAGAGCTTCGAGACCG 700
ACACCAACCTGAACTTCCAGAACCTGAGCGTGATCGGCTTCCGCATCCTG 750
CTGCTGAAGGTGGCCGGCTTCAACCTGCTGATGACCCTGCGCCTGTGGAG 800
CAGC [SEQ ID NO: 506]

Beta chain:

ATGGGCTTCCGCCTGCTGTGCTGCGTGGCCTTCTGCCTGCTGGGCGCCGG 50
CCCCGTGGACAGCGGCGTGACCCAGACCCCCAAGCACCTGATCACCGCCA 100
CCGGCCAGCGCGTGACCCTGCGCTGCAGCCCCCGCAGCGGCGACCTGAGC 150
GTGTACTGGTACCAGCAGAGCCTGGACCAGGGCCTGCAGTTCCTGATCCA 200
GTACTACAACGGCGAGGAGCGCGCCAAGGGCAACATCCTGGAGCGCTTCA 250
GCGCCCAGCAGTTCCCCGACCTGCACAGCGAGCTGAACCTGAGCAGCCTG 300
GAGCTGGGCGACAGCGCCCTGTACTTCTGCGCCAGCAGCGTGGCCCCCTT 350
CTACGAGCAGTACTTCGGCCCCGGCACCCGCCTGACCGTGACCGAGGACC 400
TGAACAAGGTGTTCCCCCCCGAGGTGGCCGTGTTCGAGCCCAGCGAGGCC 450
GAGATCAGCCACACCCAGAAGGCCACCCTGGTGTGCCTGGCCACCGGCTT 500
CTTCCCCGACCACGTGGAGCTGAGCTGGTGGGTGAACGGCAAGGAGGTGC 550
ACAGCGGCGTGTGCACCGACCCCCAGCCCCTGAAGGAGCAGCCCGCCCTG 600
AACGACAGCCGCTACTGCCTGAGCAGCCGCCTGCGCGTGAGCGCCACCTT 650
CTGGCAGAACCCCCGCAACCACTTCCGCTGCCAGGTGCAGTTCTACGGCC 700
TGAGCGAGAACGACGAGTGGACCCAGGACCGCGCCAAGCCCGTGACCCAG 750
ATCGTGAGCGCCGAGGCCTGGGGCCGCGCCGACTGCGGCTTCACCAGCGT 800
GAGCTACCAGCAGGGCGTGCTGAGCGCCACCATCCTGTACGAGATCCTGC 850
TGGGCAAGGCCACCCTGTACGCCGTGCTGGTGAGCGCCCTGGTGCTGATG 900
GCCATGGTGAAGCGCAAGGACTTC [SEQ ID NO: 587]

FIG. 26

Donor R7Z Clone 3 (SSC)

Alpha chain:

ATGGCCAGCGCCCCCATCAGCATGCTGGCCATGCTGTTCACCCTGAGCGG 50
CCTGCGCGCCCAGAGCGTGGCCCAGCCCGAGGACCAGGTGAACGTGGCCG 100
AGGGCAACCCCCTGACCGTGAAGTGCACCTACAGCGTGAGCGGCAACCCC 150
TACCTGTTCTGGTACGTGCAGTACCCCAACCGCGGCCTGCAGTTCCTGCT 200
GAAGTACATCACCGGCGACAACCTGGTGAAGGGCAGCTACGGCTTCGAGG 250
CCGAGTTCAACAAGAGCCAGACCAGCTTCCACCTGAAGAAGCCCAGCGCC 300
CTGGTGAGCGACAGCGCCCTGTACTTCTGCGCCGTGCGCGAGGCCAGCGG 350
CGCCAACAACCTGTTCTTCGGCACCGGCACCCGCCTGACCGTGATCCCCT 400
ACATCCAGAACCCCGACCCCGCCGTGTACCAGCTGCGCGACAGCAAGAGC 450
AGCGACAAGAGCGTGTGCCTGTTCACCGACTTCGACAGCCAGACCAACGT 500
GAGCCAGAGCAAGGACAGCGACGTGTACATCACCGACAAGTGCGTGCTGG 550
ACATGCGCAGCATGGACTTCAAGAGCAACAGCGCCGTGGCCTGGAGCAAC 600
AAGAGCGACTTCGCCTGCGCCAACGCCTTCAACAACAGCATCATCCCCGA 650
GGACACCTTCTTCCCCAGCCCCGAGAGCAGCTGCGACGTGAAGCTGGTGG 700
AGAAGAGCTTCGAGACCGACACCAACCTGAACTTCCAGAACCTGAGCGTG 750
ATCGGCTTCCGCATCCTGCTGCTGAAGGTGGCCGGCTTCAACCTGCTGAT 800
GACCCTGCGCCTGTGGAGCAGC [SEQ ID NO: 507]

Beta chain:

ATGCTGTGCAGCCTGCTGGCCCTGCTGCTGGGCACCTTCTTCGGCGTGCG 50
CAGCCAGACCATCCACCAGTGGCCCGCCACCCTGGTGCAGCCCGTGGGCA 100
GCCCCCTGAGCCTGGAGTGCACCGTGGAGGGCACCAGCAACCCCAACCTG 150
TACTGGTACCGCCAGGCCGCCGGCCGCGGCCTGCAGCTGCTGTTCTACAG 200
CGTGGGCATCGGCCAGATCAGCAGCGAGGTGCCCCAGAACCTGAGCGCCA 250
GCCGCCCCCAGGACCGCCAGTTCATCCTGAGCAGCAAGAAGCTGCTGCTG 300
AGCGACAGCGGCTTCTACCTGTGCGCCTGGAGCCCCCAGGGCAACAGCCC 350
CCTGCACTTCGGCAACGGCACCCGCCTGACCGTGACCGAGGACCTGAACA 400
AGGTGTTCCCCCCCGAGGTGGCCGTGTTCGAGCCCAGCGAGGCCGAGATC 450
AGCCACACCCAGAAGGCCACCCTGGTGTGCCTGGCCACCGGCTTCTTCCC 500
CGACCACGTGGAGCTGAGCTGGTGGGTGAACGGCAAGGAGGTGCACAGCG 550
GCGTGTGCACCGACCCCCAGCCCCTGAAGGAGCAGCCCGCCCTGAACGAC 600
AGCCGCTACTGCCTGAGCAGCCGCCTGCGCGTGAGCGCCACCTTCTGGCA 650
GAACCCCCGCAACCACTTCCGCTGCCAGGTGCAGTTCTACGGCCTGAGCG 700
AGAACGACGAGTGGACCCAGGACCGCGCCAAGCCCGTGACCCAGATCGTG 750
AGCGCCGAGGCCTGGGGCCGCGCCGACTGCGGCTTCACCAGCGTGAGCTA 800
CCAGCAGGGCGTGCTGAGCGCCACCATCCTGTACGAGATCCTGCTGGGCA 850
AGGCCACCCTGTACGCCGTGCTGGTGAGCGCCCTGGTGCTGATGGCCATG 900
GTGAAGCGCAAGGACTTC [SEQ ID NO: 588]

FIG. 27

Donor R7Z Clone 4 (SSC)

Alpha chain:
ATGCTGCTGCTGCTGGTGCCCGTGCTGGAGGTGATCTTCACCCTGGGCGG 50
CACCCGCGCCCAGAGCGTGACCCAGCTGGACAGCCACGTGAGCGTGAGCG 100
AGGGCACCCCCGTGCTGCTGCGCTGCAACTACAGCAGCAGCTACAGCCCC 150
AGCCTGTTCTGGTACGTGCAGCACCCCAACAAGGGCCTGCAGCTGCTGCT 200
GAAGTACACCAGCGCCGCCACCCTGGTGAAGGGCATCAACGGCTTCGAGG 250
CCGAGTTCAAGAAGAGCGAGACCAGCTTCCACCTGACCAAGCCCAGCGCC 300
CACATGAGCGACGCCGCCGAGTACTTCTGCGTGGTGAGCTACCTGGGCGA 350
CACCGGCCGCCGCGCCCTGACCTTCGGCAGCGGCACCCGCCTGCAGGTGC 400
AGCCCAACATCCAGAACCCCGACCCCGCCGTGTACCAGCTGCGCGACAGC 450
AAGAGCAGCGACAAGAGCGTGTGCCTGTTCACCGACTTCGACAGCCAGAC 500
CAACGTGAGCCAGAGCAAGGACAGCGACGTGTACATCACCGACAAGTGCG 550
TGCTGGACATGCGCAGCATGGACTTCAAGAGCAACAGCGCCGTGGCCTGG 600
AGCAACAAGAGCGACTTCGCCTGCGCCAACGCCTTCAACAACAGCATCAT 650
CCCCGAGGACACCTTCTTCCCCAGCCCCGAGAGCAGCTGCGACGTGAAGC 700
TGGTGGAGAAGAGCTTCGAGACCGACACCAACCTGAACTTCCAGAACCTG 750
AGCGTGATCGGCTTCCGCATCCTGCTGCTGAAGGTGGCCGGCTTCAACCT 800
GCTGATGACCCTGCGCCTGTGGAGCAGC [SEQ ID NO: 508]

Beta chain:
ATGGACACCTGGCTGGTGTGCTGGGCCATCTTCAGCCTGCTGAAGGCCGG 50
CCTGACCGAGCCCGAGGTGACCCAGACCCCCAGCCACCAGGTGACCCAGA 100
TGGGCCAGGAGGTGATCCTGCGCTGCGTGCCCATCAGCAACCACCTGTAC 150
TTCTACTGGTACCGCCAGATCCTGGGCCAGAAGGTGGAGTTCCTGGTGAG 200
CTTCTACAACAACGAGATCAGCGAGAAGAGCGAGATCTTCGACGACCAGT 250
TCAGCGTGGAGCGCCCCGACGGCAGCAACTTCACCCTGAAGATCCGCAGC 300
ACCAAGCTGGAGGACAGCGCCATGTACTTCTGCGCCAGCAGCGAGAGCGG 350
CAGCCCCACCGGCGAGCTGTTCTTCGGCGAGGGCAGCCGCCTGACCGTGC 400
TGGAGGACCTGAACAAGGTGTTCCCCCCCGAGGTGGCCGTGTTCGAGCCC 450
AGCGAGGCCGAGATCAGCCACACCCAGAAGGCCACCCTGGTGTGCCTGGC 500
CACCGGCTTCTTCCCCGACCACGTGGAGCTGAGCTGGTGGGTGAACGGCA 550
AGGAGGTGCACAGCGGCGTGTGCACCGACCCCCAGCCCCTGAAGGAGCAG 600
CCCGCCCTGAACGACAGCCGCTACTGCCTGAGCAGCCGCCTGCGCGTGAG 650
CGCCACCTTCTGGCAGAACCCCCGCAACCACTTCCGCTGCCAGGTGCAGT 700
TCTACGGCCTGAGCGAGAACGACGAGTGGACCCAGGACCGCGCCAAGCCC 750
GTGACCCAGATCGTGAGCGCCGAGGCCTGGGGCCGCGCCGACTGCGGCTT 800
CACCAGCGTGAGCTACCAGCAGGGCGTGCTGAGCGCCACCATCCTGTACG 850
AGATCCTGCTGGGCAAGGCCACCCTGTACGCCGTGCTGGTGAGCGCCCTG 900
GTGCTGATGGCCATGGTGAAGCGCAAGGACTTC [SEQ ID NO: 589]

FIG. 28

Donor R7Z Clone 5 (SSC)

Alpha chain:
ATGAAGCGCATCCTGGGCGCCCTGCTGGGCCTGCTGAGCGCCCAGGTGTG 50
CTGCGTGCGCGGCATCCAGGTGGAGCAGAGCCCCCCGACCTGATCCTGC 100
AGGAGGGCGCCAACAGCACCCTGCGCTGCAACTTCAGCGACAGCGTGAAC 150
AACCTGCAGTGGTTCCACCAGAACCCCTGGGGCCAGCTGATCAACCTGTT 200
CTACATCCCCAGCGGCACCAAGCAGAACGGCCGCCTGAGCGCCACCACCG 250
TGGCCACCGAGCGCTACAGCCTGCTGTACATCAGCAGCAGCCAGACCACC 300
GACAGCGGCGTGTACTTCTGCGCCGTGGTGGGCAACAACGACATGCGCTT 350
CGGCGCCGGCACCCGCCTGACCGTGAAGCCCAACATCCAGAACCCCGACC 400
CCGCCGTGTACCAGCTGCGCGACAGCAAGAGCAGCGACAAGAGCGTGTGC 450
CTGTTCACCGACTTCGACAGCCAGACCAACGTGAGCCAGAGCAAGGACAG 500
CGACGTGTACATCACCGACAAGTGCGTGCTGGACATGCGCAGCATGGACT 550
TCAAGAGCAACAGCGCCGTGGCCTGGAGCAACAAGAGCGACTTCGCCTGC 600
GCCAACGCCTTCAACAACAGCATCATCCCCGAGGACACCTTCTTCCCCAG 650
CCCCGAGAGCAGCTGCGACGTGAAGCTGGTGGAGAAGAGCTTCGAGACCG 700
ACACCAACCTGAACTTCCAGAACCTGAGCGTGATCGGCTTCCGCATCCTG 750
CTGCTGAAGGTGGCCGGCTTCAACCTGCTGATGACCCTGCGCCTGTGGAG 800
CAGC [SEQ ID NO: 509]

Beta chain:
ATGGGCTTCCGCCTGCTGTGCTGCGTGGCCTTCTGCCTGCTGGGCGCCGG 50
CCCCGTGGACAGCGGCGTGACCCAGACCCCCAAGCACCTGATCACCGCCA 100
CCGGCCAGCGCGTGACCCTGCGCTGCAGCCCCCGCAGCGGCGACCTGAGC 150
GTGTACTGGTACCAGCAGAGCCTGGACCAGGGCCTGCAGTTCCTGATCCA 200
GTACTACAACGGCGAGGAGCGCGCCAAGGGCAACATCCTGGAGCGCTTCA 250
GCGCCCAGCAGTTCCCCGACCTGCACAGCGAGCTGAACCTGAGCAGCCTG 300
GAGCTGGGCGACAGCGCCCTGTACTTCTGCGCCAGCAGCGTGGCCCCCTG 350
GTACGAGCAGTACTTCGGCCCCGGCACCCGCCTGACCGTGACCGAGGACC 400
TGAACAAGGTGTTCCCCCCCGAGGTGGCCGTGTTCGAGCCCAGCGAGGCC 450
GAGATCAGCCACACCCAGAAGGCCACCCTGGTGTGCCTGGCCACCGGCTT 500
CTTCCCCGACCACGTGGAGCTGAGCTGGTGGGTGAACGGCAAGGAGGTGC 550
ACAGCGGCGTGTGCACCGACCCCCAGCCCCTGAAGGAGCAGCCCGCCCTG 600
AACGACAGCCGCTACTGCCTGAGCAGCCGCCTGCGCGTGAGCGCCACCTT 650
CTGGCAGAACCCCCGCAACCACTTCCGCTGCCAGGTGCAGTTCTACGGCC 700
TGAGCGAGAACGACGAGTGGACCCAGGACCGCGCCAAGCCCGTGACCCAG 750
ATCGTGAGCGCCGAGGCCTGGGGCCGCGCCGACTGCGGCTTCACCAGCGT 800
GAGCTACCAGCAGGGCGTGCTGAGCGCCACCATCCTGTACGAGATCCTGC 850
TGGGCAAGGCCACCCTGTACGCCGTGCTGGTGAGCGCCCTGGTGCTGATG 900
GCCATGGTGAAGCGCAAGGACTTC [SEQ ID NO: 590]

FIG. 29

Donor B5F Clone 1 (SSC)

Alpha chain:
ATGAAGCGCATCCTGGGCGCCCTGCTGGGCCTGCTGAGCGCCCAGGTGTG 50
CTGCGTGCGCGGCATCCAGGTGGAGCAGAGCCCCCCCGACCTGATCCTGC 100
AGGAGGGCGCCAACAGCACCCTGCGCTGCAACTTCAGCGACAGCGTGAAC 150
AACCTGCAGTGGTTCCACCAGAACCCCTGGGGCCAGCTGATCAACCTGTT 200
CTACATCCCCAGCGGCACCAAGCAGAACGGCCGCCTGAGCGCCACCACCG 250
TGGCCACCGAGCGCTACAGCCTGCTGTACATCAGCAGCAGCCAGACCACC 300
GACAGCGGCGTGTACTTCTGCGCCGTGCTGAACAACAACGACATGCGCTT 350
CGGCGCCGGCACCCGCCTGACCGTGAAGCCCAACATCCAGAACCCCGACC 400
CCGCCGTGTACCAGCTGCGCGACAGCAAGAGCAGCGACAAGAGCGTGTGC 450
CTGTTCACCGACTTCGACAGCCAGACCAACGTGAGCCAGAGCAAGGACAG 500
CGACGTGTACATCACCGACAAGTGCGTGCTGGACATGCGCAGCATGGACT 550
TCAAGAGCAACAGCGCCGTGGCCTGGAGCAACAAGAGCGACTTCGCCTGC 600
GCCAACGCCTTCAACAACAGCATCATCCCCGAGGACACCTTCTTCCCCAG 650
CCCCGAGAGCAGCTGCGACGTGAAGCTGGTGGAGAAGAGCTTCGAGACCG 700
ACACCAACCTGAACTTCCAGAACCTGAGCGTGATCGGCTTCCGCATCCTG 750
CTGCTGAAGGTGGCCGGCTTCAACCTGCTGATGACCCTGCGCCTGTGGAG 800
CAGC [SEQ ID NO: 510]

Beta chain:
ATGGGCTTCCGCCTGCTGTGCTGCGTGGCCTTCTGCCTGCTGGGCGCCGG 50
CCCCGTGGACAGCGGCGTGACCCAGACCCCCAAGCACCTGATCACCGCCA 100
CCGGCCAGCGCGTGACCCTGCGCTGCAGCCCCCGCAGCGGCGACCTGAGC 150
GTGTACTGGTACCAGCAGAGCCTGGACCAGGGCCTGCAGTTCCTGATCCA 200
GTACTACAACGGCGAGGAGCGCGCCAAGGGCAACATCCTGGAGCGCTTCA 250
GCGCCCAGCAGTTCCCCGACCTGCACAGCGAGCTGAACCTGAGCAGCCTG 300
GAGCTGGGCGACAGCGCCCTGTACTTCTGCGCCAGCAGCGTGAGCAGCTG 350
GTACGAGCAGTTCTTCGGCCCCGGCACCCGCCTGACCGTGCTGGAGGACC 400
TGAACAAGGTGTTCCCCCCCGAGGTGGCCGTGTTCGAGCCCAGCGAGGCC 450
GAGATCAGCCACACCCAGAAGGCCACCCTGGTGTGCCTGGCCACCGGCTT 500
CTTCCCCGACCACGTGGAGCTGAGCTGGTGGGTGAACGGCAAGGAGGTGC 550
ACAGCGGCGTGTGCACCGACCCCCAGCCCCTGAAGGAGCAGCCCGCCCTG 600
AACGACAGCCGCTACTGCCTGAGCAGCCGCCTGCGCGTGAGCGCCACCTT 650
CTGGCAGAACCCCCGCAACCACTTCCGCTGCCAGGTGCAGTTCTACGGCC 700
TGAGCGAGAACGACGAGTGGACCCAGGACCGCGCCAAGCCCGTGACCCAG 750
ATCGTGAGCGCCGAGGCCTGGGGCCGCGCCGACTGCGGCTTCACCAGCGT 800
GAGCTACCAGCAGGGCGTGCTGAGCGCCACCATCCTGTACGAGATCCTGC 850
TGGGCAAGGCCACCCTGTACGCCGTGCTGGTGAGCGCCCTGGTGCTGATG 900
GCCATGGTGAAGCGCAAGGACTTC [SEQ ID NO: 591]

FIG. 30

Donor B5F Clone 2 (SSC)

Alpha chain:

ATGGCCGGCATCCGCGCCCTGTTCATGTACCTGTGGCTGCAGCTGGACTG 50
GGTGAGCCGCGGCGAGAGCGTGGGCCTGCACCTGCCCACCCTGAGCGTGC 100
AGGAGGGCGACAACAGCATCATCAACTGCGCCTACAGCAACAGCGCCAGC 150
GACTACTTCATCTGGTACAAGCAGGAGAGCGGCAAGGGCCCCCAGTTCAT 200
CATCGACATCCGCAGCAACATGGACAAGCGCCAGGGCCAGCGCGTGACCG 250
TGCTGCTGAACAAGACCGTGAAGCACCTGAGCCTGCAGATCGCCGCCACC 300
CAGCCCGGCGACAGCGCCGTGTACTTCTGCGCCGAGACCCCCGGCGGCTA 350
CCAGAAGGTGACCTTCGGCACCGGCACCAAGCTGCAGGTGATCCCCAACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 511]

Beta chain:

ATGGGCCCCCAGCTGCTGGGCTACGTGGTGCTGTGCCTGCTGGGCGCCGG 50
CCCCCTGGAGGCCCAGGTGACCCAGAACCCCCGCTACCTGATCACCGTGA 100
CCGGCAAGAAGCTGACCGTGACCTGCAGCCAGAACATGAACCACGAGTAC 150
ATGAGCTGGTACCGCCAGGACCCCGGCCTGGGCCTGCGCCAGATCTACTA 200
CAGCATGAACGTGGAGGTGACCGACAAGGGCGACGTGCCCGAGGGCTACA 250
AGGTGAGCCGCAAGGAGAAGCGCAACTTCCCCCTGATCCTGGAGAGCCCC 300
AGCCCCAACCAGACCAGCCTGTACTTCTGCGCCAGCAGCCTGTGGACCAG 350
CAACAGCCCCCTGCACTTCGGCAACGGCACCCGCCTGACCGTGACCGAGG 400
ACCTGAACAAGGTGTTCCCCCCCGAGGTGGCCGTGTTCGAGCCCAGCGAG 450
GCCGAGATCAGCCACACCCAGAAGGCCACCCTGGTGTGCCTGGCCACCGG 500
CTTCTTCCCCGACCACGTGGAGCTGAGCTGGTGGGTGAACGGCAAGGAGG 550
TGCACAGCGGCGTGTGCACCGACCCCCAGCCCCTGAAGGAGCAGCCCGCC 600
CTGAACGACAGCCGCTACTGCCTGAGCAGCCGCCTGCGCGTGAGCGCCAC 650
CTTCTGGCAGAACCCCCGCAACCACTTCCGCTGCCAGGTGCAGTTCTACG 700
GCCTGAGCGAGAACGACGAGTGGACCCAGGACCGCGCCAAGCCCGTGACC 750
CAGATCGTGAGCGCCGAGGCCTGGGGCCGCGCCGACTGCGGCTTCACCAG 800
CGTGAGCTACCAGCAGGGCGTGCTGAGCGCCACCATCCTGTACGAGATCC 850
TGCTGGGCAAGGCCACCCTGTACGCCGTGCTGGTGAGCGCCCTGGTGCTG 900
ATGGCCATGGTGAAGCGCAAGGACTTC [SEQ ID NO: 592]

FIG. 31

Donor T3V Clone 1 (SSC)

Alpha chain:

ATGGCCATGCTGCTGGGCGCCAGCGTGCTGATCCTGTGGCTGCAGCCCGA 50
CTGGGTGAACAGCCAGCAGAAGAACGACGACCAGCAGGTGAAGCAGAACA 100
GCCCCAGCCTGAGCGTGCAGGAGGGCCGCATCAGCATCCTGAACTGCGAC 150
TACACCAACAGCATGTTCGACTACTTCCTGTGGTACAAGAAGTACCCCGC 200
CGAGGGCCCCACCTTCCTGATCAGCATCAGCAGCATCAAGGACAAGAACG 250
AGGACGGCCGCTTCACCGTGTTCCTGAACAAGAGCGCCAAGCACCTGAGC 300
CTGCACATCGTGCCCAGCCAGCCCGGCGACAGCGCCGTGTACTTCTGCGC 350
CGCCAGCGCCGGCGGCCAGAACTTCGTGTTCGGCCCCGGCACCCGCCTGA 400
GCGTGCTGCCCTACATCCAGAACCCCGACCCCGCCGTGTACCAGCTGCGC 450
GACAGCAAGAGCAGCGACAAGAGCGTGTGCCTGTTCACCGACTTCGACAG 500
CCAGACCAACGTGAGCCAGAGCAAGGACAGCGACGTGTACATCACCGACA 550
AGTGCGTGCTGGACATGCGCAGCATGGACTTCAAGAGCAACAGCGCCGTG 600
GCCTGGAGCAACAAGAGCGACTTCGCCTGCGCCAACGCCTTCAACAACAG 650
CATCATCCCCGAGGACACCTTCTTCCCCAGCCCCGAGAGCAGCTGCGACG 700
TGAAGCTGGTGGAGAAGAGCTTCGAGACCGACACCAACCTGAACTTCCAG 750
AACCTGAGCGTGATCGGCTTCCGCATCCTGCTGCTGAAGGTGGCCGGCTT 800
CAACCTGCTGATGACCCTGCGCCTGTGGAGCAGC [SEQ ID NO: 512]

Beta chain:

ATGGGCACCCGCCTGTTCTTCTACGTGGCCCTGTGCCTGCTGTGGACCGG 50
CCACATGGACGCCGGCATCACCCAGAGCCCCCGCCACAAGGTGACCGAGA 100
CCGGCACCCCCGTGACCCTGCGCTGCCACCAGACCGAGAACCACCGCTAC 150
ATGTACTGGTACCGCCAGGACCCCGGCCACGGCCTGCGCCTGATCCACTA 200
CAGCTACGGCGTGAAGGACACCGACAAGGGCGAGGTGAGCGACGGCTACA 250
GCGTGAGCCGCAGCAAGACCGAGGACTTCCTGCTGACCCTGGAGAGCGCC 300
ACCAGCAGCCAGACCAGCGTGTACTTCTGCGCCATCCGCCGCGGCGGCAG 350
CAGCTACAACGAGCAGTTCTTCGGCCCCGGCACCCGCCTGACCGTGCTGG 400
AGGACCTGAACAAGGTGTTCCCCCCCGAGGTGGCCGTGTTCGAGCCCAGC 450
GAGGCCGAGATCAGCCACACCCAGAAGGCCACCCTGGTGTGCCTGGCCAC 500
CGGCTTCTTCCCCGACCACGTGGAGCTGAGCTGGTGGGTGAACGGCAAGG 550
AGGTGCACAGCGGCGTGTGCACCGACCCCCAGCCCCTGAAGGAGCAGCCC 600
GCCCTGAACGACAGCCGCTACTGCCTGAGCAGCCGCCTGCGCGTGAGCGC 650
CACCTTCTGGCAGAACCCCCGCAACCACTTCCGCTGCCAGGTGCAGTTCT 700
ACGGCCTGAGCGAGAACGACGAGTGGACCCAGGACCGCGCCAAGCCCGTG 750
ACCCAGATCGTGAGCGCCGAGGCCTGGGGCCGCGCCGACTGCGGCTTCAC 800
CAGCGTGAGCTACCAGCAGGGCGTGCTGAGCGCCACCATCCTGTACGAGA 850
TCCTGCTGGGCAAGGCCACCCTGTACGCCGTGCTGGTGAGCGCCCTGGTG 900
CTGATGGCCATGGTGAAGCGCAAGGACTTC [SEQ ID NO: 593]

FIG. 32

Donor T3V Clone 2 (SSC)

Alpha chain:

```
ATGTGGGGCGTGTTCCTGCTGTACGTGAGCATGAAGATGGGCGGCACCAC     50
CGGCCAGAACATCGACCAGCCCACCGAGATGACCGCCACCGAGGGCGCCA    100
TCGTGCAGATCAACTGCACCTACCAGACCAGCGGCTTCAACGGCCTGTTC    150
TGGTACCAGCAGCACGCCGGCGAGGCCCCCACCTTCCTGAGCTACAACGT    200
GCTGGACGGCCTGGAGGAGAAGGGCCGCTTCAGCAGCTTCCTGAGCCGCA    250
GCAAGGGCTACAGCTACCTGCTGCTGAAGGAGCTGCAGATGAAGGACAGC    300
GCCAGCTACCTGTGCGCCGTGAAGGACAGCAACTACCAGCTGATCTGGGG    350
CGCCGGCACCAAGCTGATCATCAAGCCCGACATCCAGAACCCCGACCCCG    400
CCGTGTACCAGCTGCGCGACAGCAAGAGCAGCGACAAGAGCGTGTGCCTG    450
TTCACCGACTTCGACAGCCAGACCAACGTGAGCCAGAGCAAGGACAGCGA    500
CGTGTACATCACCGACAAGTGCGTGCTGGACATGCGCAGCATGGACTTCA    550
AGAGCAACAGCGCCGTGGCCTGGAGCAACAAGAGCGACTTCGCCTGCGCC    600
AACGCCTTCAACAACAGCATCATCCCCGAGGACACCTTCTTCCCCAGCCC    650
CGAGAGCAGCTGCGACGTGAAGCTGGTGGAGAAGAGCTTCGAGACCGACA    700
CCAACCTGAACTTCCAGAACCTGAGCGTGATCGGCTTCCGCATCCTGCTG    750
CTGAAGGTGGCCGGCTTCAACCTGCTGATGACCCTGCGCCTGTGGAGCAG    800
C  [SEQ ID NO: 513]
```

Beta chain:

```
ATGCGCATCCGCCTGCTGTGCTGCGTGGCCTTCAGCCTGCTGTGGGCCGG     50
CCCCGTGATCGCCGGCATCACCCAGGCCCCCACCAGCCAGATCCTGGCCG    100
CCGGCCGCCGCATGACCCTGCGCTGCACCCAGGACATGCGCCACAACGCC    150
ATGTACTGGTACCGCCAGGACCTGGGCCTGGGCCTGCGCCTGATCCACTA    200
CAGCAACACCGCCGGCACCACCGGCAAGGGCGAGGTGCCCGACGGCTACA    250
GCGTGAGCCGCGCCAACACCGACGACTTCCCCCTGACCCTGGCCAGCGCC    300
GTGCCCAGCCAGACCAGCGTGTACTTCTGCGCCAGCAGCGCCGACCAGGG    350
CGACGGCACCGACACCCAGTACTTCGGCCCCGGCACCCGCCTGACCGTGC    400
TGGAGGACCTGAACAAGGTGTTCCCCCCCGAGGTGGCCGTGTTCGAGCCC    450
AGCGAGGCCGAGATCAGCCACACCCAGAAGGCCACCCTGGTGTGCCTGGC    500
CACCGGCTTCTTCCCCGACCACGTGGAGCTGAGCTGGTGGGTGAACGGCA    550
AGGAGGTGCACAGCGGCGTGTGCACCGACCCCCAGCCCCTGAAGGAGCAG    600
CCCGCCCTGAACGACAGCCGCTACTGCCTGAGCAGCCGCCTGCGCGTGAG    650
CGCCACCTTCTGGCAGAACCCCCGCAACCACTTCCGCTGCCAGGTGCAGT    700
TCTACGGCCTGAGCGAGAACGACGAGTGGACCCAGGACCGCGCCAAGCCC    750
GTGACCCAGATCGTGAGCGCCGAGGCCTGGGGCCGCGCCGACTGCGGCTT    800
CACCAGCGTGAGCTACCAGCAGGGCGTGCTGAGCGCCACCATCCTGTACG    850
AGATCCTGCTGGGCAAGGCCACCCTGTACGCCGTGCTGGTGAGCGCCCTG    900
GTGCTGATGGCCATGGTGAAGCGCAAGGACTTC  [SEQ ID NO: 594]
```

FIG. 33

Donor T3V Clone 3 (SSC)

Alpha chain:
ATGTGGGGCGCCTTCCTGCTGTACGTGAGCATGAAGATGGGCGGCACCGC 50
CGGCCAGAGCCTGGAGCAGCCCAGCGAGGTGACCGCCGTGGAGGGCGCCA 100
TCGTGCAGATCAACTGCACCTACCAGACCAGCGGCTTCTACGGCCTGAGC 150
TGGTACCAGCAGCACGACGGCGGCGCCCCCACCTTCCTGAGCTACAACGC 200
CCTGGACGGCCTGGAGGAGACCGGCCGCTTCAGCAGCTTCCTGAGCCGCA 250
GCGACAGCTACGGCTACCTGCTGCTGCAGGAGCTGCAGATGAAGGACAGC 300
GCCAGCTACTTCTGCGCCGTGCCCCGCCGCAACAACAACGCCCGCCTGAT 350
GTTCGGCGACGGCACCCAGCTGGTGGTGAAGCCCAACATCCAGAACCCCG 400
ACCCCGCCGTGTACCAGCTGCGCGACAGCAAGAGCAGCGACAAGAGCGTG 450
TGCCTGTTCACCGACTTCGACAGCCAGACCAACGTGAGCCAGAGCAAGGA 500
CAGCGACGTGTACATCACCGACAAGTGCGTGCTGGACATGCGCAGCATGG 550
ACTTCAAGAGCAACAGCGCCGTGGCCTGGAGCAACAAGAGCGACTTCGCC 600
TGCGCCAACGCCTTCAACAACAGCATCATCCCCGAGGACACCTTCTTCCC 650
CAGCCCCGAGAGCAGCTGCGACGTGAAGCTGGTGGAGAAGAGCTTCGAGA 700
CCGACACCAACCTGAACTTCCAGAACCTGAGCGTGATCGGCTTCCGCATC 750
CTGCTGCTGAAGGTGGCCGGCTTCAACCTGCTGATGACCCTGCGCCTGTG 800
GAGCAGC [SEQ ID NO: 514]

Beta chain:
ATGGGCCCCCAGCTGCTGGGCTACGTGGTGCTGTGCCTGCTGGGCGCCGG 50
CCCCCTGGAGGCCCAGGTGACCCAGAACCCCCGCTACCTGATCACCGTGA 100
CCGGCAAGAAGCTGACCGTGACCTGCAGCCAGAACATGAACCACGAGTAC 150
ATGAGCTGGTACCGCCAGGACCCCGGCCTGGGCCTGCGCCAGATCTACTA 200
CAGCATGAACGTGGAGGTGACCGACAAGGGCGACGTGCCCGAGGGCTACA 250
AGGTGAGCCGCAAGGAGAAGCGCAACTTCCCCCTGATCCTGGAGAGCCCC 300
AGCCCCAACCAGACCAGCCTGTACTTCTGCGCCAGCAGCCTGAACACCGG 350
CATGAACACCGAGGCCTTCTTCGGCCAGGGCACCCGCCTGACCGTGGTGG 400
AGGACCTGAACAAGGTGTTCCCCCCCGAGGTGGCCGTGTTCGAGCCCAGC 450
GAGGCCGAGATCAGCCACACCCAGAAGGCCACCCTGGTGTGCCTGGCCAC 500
CGGCTTCTTCCCCGACCACGTGGAGCTGAGCTGGTGGGTGAACGGCAAGG 550
AGGTGCACAGCGGCGTGTGCACCGACCCCCAGCCCCTGAAGGAGCAGCCC 600
GCCCTGAACGACAGCCGCTACTGCCTGAGCAGCCGCCTGCGCGTGAGCGC 650
CACCTTCTGGCAGAACCCCCGCAACCACTTCCGCTGCCAGGTGCAGTTCT 700
ACGGCCTGAGCGAGAACGACGAGTGGACCCAGGACCGCGCCAAGCCCGTG 750
ACCCAGATCGTGAGCGCCGAGGCCTGGGGCCGCGCCGACTGCGGCTTCAC 800
CAGCGTGAGCTACCAGCAGGGCGTGCTGAGCGCCACCATCCTGTACGAGA 850
TCCTGCTGGGCAAGGCCACCCTGTACGCCGTGCTGGTGAGCGCCCTGGTG 900
CTGATGGCCATGGTGAAGCGCAAGGACTTC [SEQ ID NO: 595]

FIG. 34

Donor P6G Clone 1 (SSC)

Alpha chain:

```
ATGGAGACCCTGCTGGGCCTGCTGATCCTGTGGCTGCAGCTGCAGTGGGT     50
GAGCAGCAAGCAGGAGGTGACCCAGATCCCCGCCGCCCTGAGCGTGCCCG     100
AGGGCGAGAACCTGGTGCTGAACTGCAGCTTCACCGACAGCGCCATCTAC     150
AACCTGCAGTGGTTCCGCCAGGACCCCGGCAAGGGCCTGACCAGCCTGCT     200
GCTGATCCAGAGCAGCCAGCGCGAGCAGACCAGCGGCCGCCTGAACGCCA     250
GCCTGGACAAGAGCAGCGGCCGCAGCACCCTGTACATCGCCGCCAGCCAG     300
CCCGGCGACAGCGCCACCTACCTGTGCGCCGTGGGCGGCGACGACAGCGG     350
CGCCGGCAGCTACCAGCTGACCTTCGGCAAGGGCACCAAGCTGAGCGTGA     400
TCCCCAACATCCAGAACCCCGACCCCGCCGTGTACCAGCTGCGCGACAGC     450
AAGAGCAGCGACAAGAGCGTGTGCCTGTTCACCGACTTCGACAGCCAGAC     500
CAACGTGAGCCAGAGCAAGGACAGCGACGTGTACATCACCGACAAGTGCG     550
TGCTGGACATGCGCAGCATGGACTTCAAGAGCAACAGCGCCGTGGCCTGG     600
AGCAACAAGAGCGACTTCGCCTGCGCCAACGCCTTCAACAACAGCATCAT     650
CCCCGAGGACACCTTCTTCCCCAGCCCCGAGAGCAGCTGCGACGTGAAGC     700
TGGTGGAGAAGAGCTTCGAGACCGACACCAACCTGAACTTCCAGAACCTG     750
AGCGTGATCGGCTTCCGCATCCTGCTGCTGAAGGTGGCCGGCTTCAACCT     800
GCTGATGACCCTGCGCCTGTGGAGCAGC  [SEQ ID NO: 515]
```

Beta chain:

```
ATGGGCTTCCGCCTGCTGTGCTGCGTGGCCTTCTGCCTGCTGGGCGCCGG     50
CCCCGTGGACAGCGGCGTGACCCAGACCCCCAAGCACCTGATCACCGCCA     100
CCGGCCAGCGCGTGACCCTGCGCTGCAGCCCCCGCAGCGGCGACCTGAGC     150
GTGTACTGGTACCAGCAGAGCCTGGACCAGGGCCTGCAGTTCCTGATCCA     200
GTACTACAACGGCGAGGAGCGCGCCAAGGGCAACATCCTGGAGCGCTTCA     250
GCGCCCAGCAGTTCCCCGACCTGCACAGCGAGCTGAACCTGAGCAGCCTG     300
GAGCTGGGCGACAGCGCCCTGTACTTCTGCGCCAGCAGCCGCCCCGAGGG     350
CATCTACAACGAGCAGTTCTTCGGCCCCGGCACCCGCCTGACCGTGCTGG     400
AGGACCTGAACAAGGTGTTCCCCCCCGAGGTGGCCGTGTTCGAGCCCAGC     450
GAGGCCGAGATCAGCCACACCCAGAAGGCCACCCTGGTGTGCCTGGCCAC     500
CGGCTTCTTCCCCGACCACGTGGAGCTGAGCTGGTGGGTGAACGGCAAGG     550
AGGTGCACAGCGGCGTGTGCACCGACCCCCAGCCCCTGAAGGAGCAGCCC     600
GCCCTGAACGACAGCCGCTACTGCCTGAGCAGCCGCCTGCGCGTGAGCGC     650
CACCTTCTGGCAGAACCCCCGCAACCACTTCCGCTGCCAGGTGCAGTTCT     700
ACGGCCTGAGCGAGAACGACGAGTGGACCCAGGACCGCGCCAAGCCCGTG     750
ACCCAGATCGTGAGCGCCGAGGCCTGGGGCCGCGCCGACTGCGGCTTCAC     800
CAGCGTGAGCTACCAGCAGGGCGTGCTGAGCGCCACCATCCTGTACGAGA     850
TCCTGCTGGGCAAGGCCACCCTGTACGCCGTGCTGGTGAGCGCCCTGGTG     900
CTGATGGCCATGGTGAAGCGCAAGGACTTC  [SEQ ID NO: 596]
```

FIG. 35

Donor P6G Clone 2 (SSC)

Alpha chain:

ATGCTGCTGATCACCAGCATGCTGGTGCTGTGGATGCAGCTGAGCCAGGT 50
GAACGGCCAGCAGGTGATGCAGATCCCCCAGTACCAGCACGTGCAGGAGG 100
GCGAGGACTTCACCACCTACTGCAACAGCAGCACCACCCTGAGCAACATC 150
CAGTGGTACAAGCAGCGCCCCGGCGGCCACCCCGTGTTCCTGATCCAGCT 200
GGTGAAGAGCGGCGAGGTGAAGAAGCAGAAGCGCCTGACCTTCCAGTTCG 250
GCGAGGCCAAGAAGAACAGCAGCCTGCACATCACCGCCACCCAGACCACC 300
GACGTGGGCACCTACTTCTGCGCCGGCCCCGGCATCTACAACCAGGGCGG 350
CAAGCTGATCTTCGGCCAGGGCACCGAGCTGAGCGTGAAGCCCAACATCC 400
AGAACCCCGACCCCGCCGTGTACCAGCTGCGCGACAGCAAGAGCAGCGAC 450
AAGAGCGTGTGCCTGTTCACCGACTTCGACAGCCAGACCAACGTGAGCCA 500
GAGCAAGGACAGCGACGTGTACATCACCGACAAGTGCGTGCTGGACATGC 550
GCAGCATGGACTTCAAGAGCAACAGCGCCGTGGCCTGGAGCAACAAGAGC 600
GACTTCGCCTGCGCCAACGCCTTCAACAACAGCATCATCCCCGAGGACAC 650
CTTCTTCCCCAGCCCCGAGAGCAGCTGCGACGTGAAGCTGGTGGAGAAGA 700
GCTTCGAGACCGACACCAACCTGAACTTCCAGAACCTGAGCGTGATCGGC 750
TTCCGCATCCTGCTGCTGAAGGTGGCCGGCTTCAACCTGCTGATGACCCT 800
GCGCCTGTGGAGCAGC [SEQ ID NO: 516]

Beta chain:

ATGAGCAACCAGGTGCTGTGCTGCGTGGTGCTGTGCTTCCTGGGCGCCAA 50
CACCGTGGACGGCGGCATCACCCAGAGCCCCAAGTACCTGTTCCGCAAGG 100
AGGGCCAGAACGTGACCCTGAGCTGCGAGCAGAACCTGAACCACGACGCC 150
ATGTACTGGTACCGCCAGGACCCCGGCCAGGGCCTGCGCCTGATCTACTA 200
CAGCCAGATCGTGAACGACTTCCAGAAGGGCGACATCGCCGAGGGCTACA 250
GCGTGAGCCGCGAGAAGAAGGAGAGCTTCCCCCTGACCGTGACCAGCGCC 300
CAGAAGAACCCCACCGCCTTCTACCTGTGCGCCAGCAGCCCCGGCCTGGC 350
CGACTACGAGCAGTACTTCGGCCCCGGCACCCGCCTGACCGTGACCGAGG 400
ACCTGAACAAGGTGTTCCCCCCCGAGGTGGCCGTGTTCGAGCCCAGCGAG 450
GCCGAGATCAGCCACACCCAGAAGGCCACCCTGGTGTGCCTGGCCACCGG 500
CTTCTTCCCCGACCACGTGGAGCTGAGCTGGTGGGTGAACGGCAAGGAGG 550
TGCACAGCGGCGTGTGCACCGACCCCCAGCCCCTGAAGGAGCAGCCCGCC 600
CTGAACGACAGCCGCTACTGCCTGAGCAGCCGCCTGCGCGTGAGCGCCAC 650
CTTCTGGCAGAACCCCCGCAACCACTTCCGCTGCCAGGTGCAGTTCTACG 700
GCCTGAGCGAGAACGACGAGTGGACCCAGGACCGCGCCAAGCCCGTGACC 750
CAGATCGTGAGCGCCGAGGCCTGGGGCCGCGCCGACTGCGGCTTCACCAG 800
CGTGAGCTACCAGCAGGGCGTGCTGAGCGCCACCATCCTGTACGAGATCC 850
TGCTGGGCAAGGCCACCCTGTACGCCGTGCTGGTGAGCGCCCTGGTGCTG 900
ATGGCCATGGTGAAGCGCAAGGACTTC [SEQ ID NO: 597]

FIG. 36

Donor P6G Clone 3 (SSC)

Alpha chain:

```
ATGAGCCTGAGCAGCCTGCTGAAGGTGGTGACCGCCAGCCTGTGGCTGGG      50
CCCCGGCATCGCCCAGAAGATCACCCAGACCCAGCCCGGCATGTTCGTGC      100
AGGAGAAGGAGGCCGTGACCCTGGACTGCACCTACGACACCAGCGACCCC      150
AGCTACGGCCTGTTCTGGTACAAGCAGCCCAGCAGCGGCGAGATGATCTT      200
CCTGATCTACCAGGGCAGCTACGACCAGCAGAACGCCACCGAGGGCCGCT      250
ACAGCCTGAACTTCCAGAAGGCCCGCAAGAGCGCCAACCTGGTGATCAGC      300
GCCAGCCAGCTGGGCGACAGCGCCATGTACTTCTGCGCCATGAGCAGCAG      350
CAACGCCGGCGGCACCAGCTACGGCAAGCTGACCTTCGGCCAGGGCACCA      400
TCCTGACCGTGCACCCCAACATCCAGAACCCCGACCCCGCCGTGTACCAG      450
CTGCGCGACAGCAAGAGCAGCGACAAGAGCGTGTGCCTGTTCACCGACTT      500
CGACAGCCAGACCAACGTGAGCCAGAGCAAGGACAGCGACGTGTACATCA      550
CCGACAAGTGCGTGCTGGACATGCGCAGCATGGACTTCAAGAGCAACAGC      600
GCCGTGGCCTGGAGCAACAAGAGCGACTTCGCCTGCGCCAACGCCTTCAA      650
CAACAGCATCATCCCCGAGGACACCTTCTTCCCCAGCCCCGAGAGCAGCT      700
GCGACGTGAAGCTGGTGGAGAAGAGCTTCGAGACCGACACCAACCTGAAC      750
TTCCAGAACCTGAGCGTGATCGGCTTCCGCATCCTGCTGCTGAAGGTGGC      800
CGGCTTCAACCTGCTGATGACCCTGCGCCTGTGGAGCAGC [SEQ ID NO: 517]
```

Beta chain:

```
ATGCTGTGCAGCCTGCTGGCCCTGCTGCTGGGCACCTTCTTCGGCGTGCG      50
CAGCCAGACCATCCACCAGTGGCCCGCCACCCTGGTGCAGCCCGTGGGCA      100
GCCCCCTGAGCCTGGAGTGCACCGTGGAGGGCACCAGCAACCCCAACCTG      150
TACTGGTACCGCCAGGCCGCCGGCCGCGGCCTGCAGCTGCTGTTCTACAG      200
CGTGGGCATCGGCCAGATCAGCAGCGAGGTGCCCCAGAACCTGAGCGCCA      250
GCCGCCCCCAGGACCGCCAGTTCATCCTGAGCAGCAAGAAGCTGCTGCTG      300
AGCGACAGCGGCTTCTACCTGTGCGCCTGGCGCCTGGAGCAGGGCCTGAA      350
CTACGAGCAGTACTTCGGCCCCGGCACCCGCCTGACCGTGACCGAGGACC      400
TGAACAAGGTGTTCCCCCCCGAGGTGGCCGTGTTCGAGCCCAGCGAGGCC      450
GAGATCAGCCACACCCAGAAGGCCACCCTGGTGTGCCTGGCCACCGGCTT      500
CTTCCCCGACCACGTGGAGCTGAGCTGGTGGGTGAACGGCAAGGAGGTGC      550
ACAGCGGCGTGTGCACCGACCCCCAGCCCCTGAAGGAGCAGCCCGCCCTG      600
AACGACAGCCGCTACTGCCTGAGCAGCCGCCTGCGCGTGAGCGCCACCTT      650
CTGGCAGAACCCCCGCAACCACTTCCGCTGCCAGGTGCAGTTCTACGGCC      700
TGAGCGAGAACGACGAGTGGACCCAGGACCGCGCCAAGCCCGTGACCCAG      750
ATCGTGAGCGCCGAGGCCTGGGGCCGCGCCGACTGCGGCTTCACCAGCGT      800
GAGCTACCAGCAGGGCGTGCTGAGCGCCACCATCCTGTACGAGATCCTGC      850
TGGGCAAGGCCACCCTGTACGCCGTGCTGGTGAGCGCCCTGGTGCTGATG      900
GCCATGGTGAAGCGCAAGGACTTC [SEQ ID NO: 598]
```

FIG. 37

Donor A4T Clone 1 (SSC)

Alpha chain:

ATGGCCATGCTGCTGGGCGCCAGCGTGCTGATCCTGTGGCTGCAGCCCGA 50
CTGGGTGAACAGCCAGCAGAAGAACGACGACCAGCAGGTGAAGCAGAACA 100
GCCCCAGCCTGAGCGTGCAGGAGGGCCGCATCAGCATCCTGAACTGCGAC 150
TACACCAACAGCATGTTCGACTACTTCCTGTGGTACAAGAAGTACCCCGC 200
CGAGGGCCCCACCTTCCTGATCAGCATCAGCAGCATCAAGGACAAGAACG 250
AGGACGGCCGCTTCACCGTGTTCCTGAACAAGAGCGCCAAGCACCTGAGC 300
CTGCACATCGTGCCCAGCCAGCCCGGCGACAGCGCCGTGTACTTCTGCGC 350
CGCCAGCGGCCTGGTGGAGGGCAACACCCCCCTGGTGTTCGGCAAGGGCA 400
CCCGCCTGAGCGTGATCGCCAACATCCAGAACCCCGACCCCGCCGTGTAC 450
CAGCTGCGCGACAGCAAGAGCAGCGACAAGAGCGTGTGCCTGTTCACCGA 500
CTTCGACAGCCAGACCAACGTGAGCCAGAGCAAGGACAGCGACGTGTACA 550
TCACCGACAAGTGCGTGCTGGACATGCGCAGCATGGACTTCAAGAGCAAC 600
AGCGCCGTGGCCTGGAGCAACAAGAGCGACTTCGCCTGCGCCAACGCCTT 650
CAACAACAGCATCATCCCCGAGGACACCTTCTTCCCCAGCCCCGAGAGCA 700
GCTGCGACGTGAAGCTGGTGGAGAAGAGCTTCGAGACCGACACCAACCTG 750
AACTTCCAGAACCTGAGCGTGATCGGCTTCCGCATCCTGCTGCTGAAGGT 800
GGCCGGCTTCAACCTGCTGATGACCCTGCGCCTGTGGAGCAGC [SEQ ID NO: 518]

Beta chain:

ATGGGCACCCGCCTGCTGTGCTGGGCCGCCCTGTGCCTGCTGGGCGCCGA 50
GCTGACCGAGGCCGGCGTGGCCCAGAGCCCCCGCTACAAGATCATCGAGA 100
AGCGCCAGAGCGTGGCCTTCTGGTGCAACCCCATCAGCGGCCACGCCACC 150
CTGTACTGGTACCAGCAGATCCTGGGCCAGGGCCCCAAGCTGCTGATCCA 200
GTTCCAGAACAACGGCGTGGTGGACGACAGCCAGCTGCCCAAGGACCGCT 250
TCAGCGCCGAGCGCCTGAAGGGCGTGGACAGCACCCTGAAGATCCAGCCC 300
GCCAAGCTGGAGGACAGCGCCGTGTACCTGTGCGCCAGCAGCCTGTTCCC 350
CGGCACCGGCATCCACGAGCAGTACTTCGGCCCCGGCACCCGCCTGACCG 400
TGACCGAGGACCTGAACAAGGTGTTCCCCCCCGAGGTGGCCGTGTTCGAG 450
CCCAGCGAGGCCGAGATCAGCCACACCCAGAAGGCCACCCTGGTGTGCCT 500
GGCCACCGGCTTCTTCCCCGACCACGTGGAGCTGAGCTGGTGGGTGAACG 550
GCAAGGAGGTGCACAGCGGCGTGTGCACCGACCCCCAGCCCCTGAAGGAG 600
CAGCCCGCCCTGAACGACAGCCGCTACTGCCTGAGCAGCCGCCTGCGCGT 650
GAGCGCCACCTTCTGGCAGAACCCCCGCAACCACTTCCGCTGCCAGGTGC 700
AGTTCTACGGCCTGAGCGAGAACGACGAGTGGACCCAGGACCGCGCCAAG 750
CCCGTGACCCAGATCGTGAGCGCCGAGGCCTGGGGCCGCGCCGACTGCGG 800
CTTCACCAGCGTGAGCTACCAGCAGGGCGTGCTGAGCGCCACCATCCTGT 850
ACGAGATCCTGCTGGGCAAGGCCACCCTGTACGCCGTGCTGGTGAGCGCC 900
CTGGTGCTGATGGCCATGGTGAAGCGCAAGGACTTC [SEQ ID NO: 599]

FIG. 38

TCRs specific for HLA-A*24:02-TYGPVFMSL

Donor D2M Clone 1 (TYG)

Alpha chain:

```
ATGGAGACCCTGCTGGGCGTGAGCCTGGTGATCCTGTGGCTGCAGCTGGC      50
CCGCGTGAACAGCCAGCAGGGCGAGGAGGACCCCCAGGCCCTGAGCATCC     100
AGGAGGGCGAGAACGCCACCATGAACTGCAGCTACAAGACCAGCATCAAC     150
AACCTGCAGTGGTACCGCCAGAACAGCGGCCGCGGCCTGGTGCACCTGAT     200
CCTGATCCGCAGCAACGAGCGCGAGAAGCACAGCGGCCGCCTGCGCGTGA     250
CCCTGGACACCAGCAAGAAGAGCAGCAGCCTGCTGATCACCGCCAGCCGC     300
GCCGCCGACACCGCCAGCTACTTCTGCGCCACCGACGGCCCCTACGGCAA     350
CAACCGCCTGGCCTTCGGCAAGGGCAACCAGGTGGTGGTGATCCCCAACA     400
TCCAGAACCCCGACCCCGCCGTGTACCAGCTGCGCGACAGCAAGAGCAGC     450
GACAAGAGCGTGTGCCTGTTCACCGACTTCGACAGCCAGACCAACGTGAG     500
CCAGAGCAAGGACAGCGACGTGTACATCACCGACAAGTGCGTGCTGGACA     550
TGCGCAGCATGGACTTCAAGAGCAACAGCGCCGTGGCCTGGAGCAACAAG     600
AGCGACTTCGCCTGCGCCAACGCCTTCAACAACAGCATCATCCCCGAGGA     650
CACCTTCTTCCCCAGCCCCGAGAGCAGCTGCGACGTGAAGCTGGTGGAGA     700
AGAGCTTCGAGACCGACACCAACCTGAACTTCCAGAACCTGAGCGTGATC     750
GGCTTCCGCATCCTGCTGCTGAAGGTGGCCGGCTTCAACCTGCTGATGAC     800
CCTGCGCCTGTGGAGCAGC  [SEQ ID NO: 519]
```

Beta chain:

```
ATGACCATCCGCCTGCTGTGCTACATGGGCTTCTACTTCCTGGGCGCCGG      50
CCTGATGGAGGCCGACATCTACCAGACCCCCCGCTACCTGGTGATCGGCA     100
CCGGCAAGAAGATCACCCTGGAGTGCAGCCAGACCATGGGCCACGACAAG     150
ATGTACTGGTACCAGCAGGACCCCGGCATGGAGCTGCACCTGATCCACTA     200
CAGCTACGGCGTGAACAGCACCGAGAAGGGCGACCTGAGCAGCGAGAGCA     250
CCGTGAGCCGCATCCGCACCGAGCACTTCCCCCTGACCCTGGAGAGCGCC     300
CGCCCCAGCCACACCAGCCAGTACCTGTGCGCCAGCAGCCCCCTGGGCCG     350
CAGCAGCAGCTACAACGAGCAGTTCTTCGGCCCCGGCACCCGCCTGACCG     400
TGCTGGAGGACCTGAACAAGGTGTTCCCCCCCGAGGTGGCCGTGTTCGAG     450
CCCAGCGAGGCCGAGATCAGCCACACCCAGAAGGCCACCCTGGTGTGCCT     500
GGCCACCGGCTTCTTCCCCGACCACGTGGAGCTGAGCTGGTGGGTGAACG     550
GCAAGGAGGTGCACAGCGGCGTGTGCACCGACCCCCAGCCCCTGAAGGAG     600
CAGCCCGCCCTGAACGACAGCCGCTACTGCCTGAGCAGCCGCCTGCGCGT     650
GAGCGCCACCTTCTGGCAGAACCCCCGCAACCACTTCCGCTGCCAGGTGC     700
AGTTCTACGGCCTGAGCGAGAACGACGAGTGGACCCAGGACCGCGCCAAG     750
CCCGTGACCCAGATCGTGAGCGCCGAGGCCTGGGGCCGCGCCGACTGCGG     800
CTTCACCAGCGTGAGCTACCAGCAGGGCGTGCTGAGCGCCACCATCCTGT     850
ACGAGATCCTGCTGGGCAAGGCCACCCTGTACGCCGTGCTGGTGAGCGCC     900
CTGGTGCTGATGGCCATGGTGAAGCGCAAGGACTTC  [SEQ ID NO: 600]
```

FIG. 39

Donor D2M Clone 2 (TYG)

Alpha chain:

ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCACCGACGGCCCCTACGGCAA 350
CAACCGCCTGGCCTTCGGCAAGGGCAACCAGGTGGTGGTGATCCCCAACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 520]

Beta chain:

ATGACCATCCGCCTGCTGTGCTACATGGGCTTCTACTTCCTGGGCGCCGG 50
CCTGATGGAGGCCGACATCTACCAGACCCCCCGCTACCTGGTGATCGGCA 100
CCGGCAAGAAGATCACCCTGGAGTGCAGCCAGACCATGGGCCACGACAAG 150
ATGTACTGGTACCAGCAGGACCCCGGCATGGAGCTGCACCTGATCCACTA 200
CAGCTACGGCGTGAACAGCACCGAGAAGGGCGACCTGAGCAGCGAGAGCA 250
CCGTGAGCCGCATCCGCACCGAGCACTTCCCCCTGACCCTGGAGAGCGCC 300
CGCCCCAGCCACACCAGCCAGTACCTGTGCGCCAGCAGCGCCCTGGGCCA 350
GAGCAGCAGCTACAACGAGCAGTTCTTCGGCCCCGGCACCCGCCTGACCG 400
TGCTGGAGGACCTGAACAAGGTGTTCCCCCCCGAGGTGGCCGTGTTCGAG 450
CCCAGCGAGGCCGAGATCAGCCACACCCAGAAGGCCACCCTGGTGTGCCT 500
GGCCACCGGCTTCTTCCCCGACCACGTGGAGCTGAGCTGGTGGGTGAACG 550
GCAAGGAGGTGCACAGCGGCGTGTGCACCGACCCCCAGCCCCTGAAGGAG 600
CAGCCCGCCCTGAACGACAGCCGCTACTGCCTGAGCAGCCGCCTGCGCGT 650
GAGCGCCACCTTCTGGCAGAACCCCCGCAACCACTTCCGCTGCCAGGTGC 700
AGTTCTACGGCCTGAGCGAGAACGACGAGTGGACCCAGGACCGCGCCAAG 750
CCCGTGACCCAGATCGTGAGCGCCGAGGCCTGGGGCCGCGCCGACTGCGG 800
CTTCACCAGCGTGAGCTACCAGCAGGGCGTGCTGAGCGCCACCATCCTGT 850
ACGAGATCCTGCTGGGCAAGGCCACCCTGTACGCCGTGCTGGTGAGCGCC 900
CTGGTGCTGATGGCCATGGTGAAGCGCAAGGACTTC [SEQ ID NO: 601]

FIG. 40

Donor D2M Clone 3 (TYG)

Alpha chain:

ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCACCGACGGCCGCCACGGCAA 350
CAACCGCCTGGCCTTCGGCAAGGGCAACCAGGTGGTGGTGATCCCCAACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 521]

Beta chain:

ATGACCATCCGCCTGCTGTGCTACATGGGCTTCTACTTCCTGGGCGCCGG 50
CCTGATGGAGGCCGACATCTACCAGACCCCCCGCTACCTGGTGATCGGCA 100
CCGGCAAGAAGATCACCCTGGAGTGCAGCCAGACCATGGGCCACGACAAG 150
ATGTACTGGTACCAGCAGGACCCCGGCATGGAGCTGCACCTGATCCACTA 200
CAGCTACGGCGTGAACAGCACCGAGAAGGGCGACCTGAGCAGCGAGAGCA 250
CCGTGAGCCGCATCCGCACCGAGCACTTCCCCCTGACCCTGGAGAGCGCC 300
CGCCCCAGCCACACCAGCCAGTACCTGTGCGCCAGCAGCGACCTGGGCCG 350
CGGCAGCGCCGTGAACGAGCAGTTCTTCGGCCCCGGCACCCGCCTGACCG 400
TGCTGGAGGACCTGAACAAGGTGTTCCCCCCCGAGGTGGCCGTGTTCGAG 450
CCCAGCGAGGCCGAGATCAGCCACACCCAGAAGGCCACCCTGGTGTGCCT 500
GGCCACCGGCTTCTTCCCCGACCACGTGGAGCTGAGCTGGTGGGTGAACG 550
GCAAGGAGGTGCACAGCGGCGTGTGCACCGACCCCCAGCCCCTGAAGGAG 600
CAGCCCGCCCTGAACGACAGCCGCTACTGCCTGAGCAGCCGCCTGCGCGT 650
GAGCGCCACCTTCTGGCAGAACCCCCGCAACCACTTCCGCTGCCAGGTGC 700
AGTTCTACGGCCTGAGCGAGAACGACGAGTGGACCCAGGACCGCGCCAAG 750
CCCGTGACCCAGATCGTGAGCGCCGAGGCCTGGGGCCGCGCCGACTGCGG 800
CTTCACCAGCGTGAGCTACCAGCAGGGCGTGCTGAGCGCCACCATCCTGT 850
ACGAGATCCTGCTGGGCAAGGCCACCCTGTACGCCGTGCTGGTGAGCGCC 900
CTGGTGCTGATGGCCATGGTGAAGCGCAAGGACTTC [SEQ ID NO: 602]

FIG. 41

Donor B31 Clone 1 (TYG)

Alpha chain:

ATGCTGCTGATCACCAGCATGCTGGTGCTGTGGATGCAGCTGAGCCAGGT 50
GAACGGCCAGCAGGTGATGCAGATCCCCCAGTACCAGCACGTGCAGGAGG 100
GCGAGGACTTCACCACCTACTGCAACAGCAGCACCACCCTGAGCAACATC 150
CAGTGGTACAAGCAGCGCCCCGGCGGCCACCCCGTGTTCCTGATCCAGCT 200
GGTGAAGAGCGGCGAGGTGAAGAAGCAGAAGCGCCTGACCTTCCAGTTCG 250
GCGAGGCCAAGAAGAACAGCAGCCTGCACATCACCGCCACCCAGACCACC 300
GACGTGGGCACCTACTTCTGCGCCGGCGAGCGCGGCAGCACCCTGGGCCG 350
CCTGTACTTCGGCCGCGGCACCCAGCTGACCGTGTGGCCCGACATCCAGA 400
ACCCCGACCCCGCCGTGTACCAGCTGCGCGACAGCAAGAGCAGCGACAAG 450
AGCGTGTGCCTGTTCACCGACTTCGACAGCCAGACCAACGTGAGCCAGAG 500
CAAGGACAGCGACGTGTACATCACCGACAAGTGCGTGCTGGACATGCGCA 550
GCATGGACTTCAAGAGCAACAGCGCCGTGGCCTGGAGCAACAAGAGCGAC 600
TTCGCCTGCGCCAACGCCTTCAACAACAGCATCATCCCCGAGGACACCTT 650
CTTCCCCAGCCCCGAGAGCAGCTGCGACGTGAAGCTGGTGGAGAAGAGCT 700
TCGAGACCGACACCAACCTGAACTTCCAGAACCTGAGCGTGATCGGCTTC 750
CGCATCCTGCTGCTGAAGGTGGCCGGCTTCAACCTGCTGATGACCCTGCG 800
CCTGTGGAGCAGC [SEQ ID NO: 522]

Beta chain:

ATGGGCACCAGCCTGCTGTGCTGGATGGCCCTGTGCCTGCTGGGCGCCGA 50
CCACGCCGACACCGGCGTGAGCCAGAACCCCCGCCACAAGATCACCAAGC 100
GCGGCCAGAACGTGACCTTCCGCTGCGACCCCATCAGCGAGCACAACCGC 150
CTGTACTGGTACCGCCAGACCCTGGGCCAGGGCCCCGAGTTCCTGACCTA 200
CTTCCAGAACGAGGCCCAGCTGGAGAAGAGCCGCCTGCTGAGCGACCGCT 250
TCAGCGCCGAGCGCCCCAAGGGCAGCTTCAGCACCCTGGAGATCCAGCGC 300
ACCGAGCAGGGCGACAGCGCCATGTACCTGTGCGCCAGCAGCCCCCTGGA 350
CCGCGGCACCTACGAGCAGTACTTCGGCCCCGGCACCCGCCTGACCGTGA 400
CCGAGGACCTGAACAAGGTGTTCCCCCCCGAGGTGGCCGTGTTCGAGCCC 450
AGCGAGGCCGAGATCAGCCACACCCAGAAGGCCACCCTGGTGTGCCTGGC 500
CACCGGCTTCTTCCCCGACCACGTGGAGCTGAGCTGGTGGGTGAACGGCA 550
AGGAGGTGCACAGCGGCGTGTGCACCGACCCCCAGCCCCTGAAGGAGCAG 600
CCCGCCCTGAACGACAGCCGCTACTGCCTGAGCAGCCGCCTGCGCGTGAG 650
CGCCACCTTCTGGCAGAACCCCCGCAACCACTTCCGCTGCCAGGTGCAGT 700
TCTACGGCCTGAGCGAGAACGACGAGTGGACCCAGGACCGCGCCAAGCCC 750
GTGACCCAGATCGTGAGCGCCGAGGCCTGGGGCCGCGCCGACTGCGGCTT 800
CACCAGCGTGAGCTACCAGCAGGGCGTGCTGAGCGCCACCATCCTGTACG 850
AGATCCTGCTGGGCAAGGCCACCCTGTACGCCGTGCTGGTGAGCGCCCTG 900
GTGCTGATGGCCATGGTGAAGCGCAAGGACTTC [SEQ ID NO: 603]

FIG. 42

Donor B31 Clone 2 (TYG)

Alpha chain:

ATGCTGCTGATCACCAGCATGCTGGTGCTGTGGATGCAGCTGAGCCAGGT 50
GAACGGCCAGCAGGTGATGCAGATCCCCCAGTACCAGCACGTGCAGGAGG 100
GCGAGGACTTCACCACCTACTGCAACAGCAGCACCACCCTGAGCAACATC 150
CAGTGGTACAAGCAGCGCCCCGGCGGCCACCCCGTGTTCCTGATCCAGCT 200
GGTGAAGAGCGGCGAGGTGAAGAAGCAGAAGCGCCTGACCTTCCAGTTCG 250
GCGAGGCCAAGAAGAACAGCAGCCTGCACATCACCGCCACCCAGACCACC 300
GACGTGGGCACCTACTTCTGCGCCGGCGAGCGCGGCAGCACCCTGGGCCG 350
CCTGTACTTCGGCCGCGGCACCCAGCTGACCGTGTGGCCCGACATCCAGA 400
ACCCCGACCCCGCCGTGTACCAGCTGCGCGACAGCAAGAGCAGCGACAAG 450
AGCGTGTGCCTGTTCACCGACTTCGACAGCCAGACCAACGTGAGCCAGAG 500
CAAGGACAGCGACGTGTACATCACCGACAAGTGCGTGCTGGACATGCGCA 550
GCATGGACTTCAAGAGCAACAGCGCCGTGGCCTGGAGCAACAAGAGCGAC 600
TTCGCCTGCGCCAACGCCTTCAACAACAGCATCATCCCCGAGGACACCTT 650
CTTCCCCAGCCCCGAGAGCAGCTGCGACGTGAAGCTGGTGGAGAAGAGCT 700
TCGAGACCGACACCAACCTGAACTTCCAGAACCTGAGCGTGATCGGCTTC 750
CGCATCCTGCTGCTGAAGGTGGCCGGCTTCAACCTGCTGATGACCCTGCG 800
CCTGTGGAGCAGC [SEQ ID NO: 523]

Beta chain:

ATGGGCACCAGCCTGCTGTGCTGGATGGCCCTGTGCCTGCTGGGCGCCGA 50
CCACGCCGACACCGGCGTGAGCCAGAACCCCCGCCACAAGATCACCAAGC 100
GCGGCCAGAACGTGACCTTCCGCTGCGACCCCATCAGCGAGCACAACCGC 150
CTGTACTGGTACCGCCAGACCCTGGGCCAGGGCCCCGAGTTCCTGACCTA 200
CTTCCAGAACGAGGCCCAGCTGGAGAAGAGCCGCCTGCTGAGCGACCGCT 250
TCAGCGCCGAGCGCCCCAAGGGCAGCTTCAGCACCCTGGAGATCCAGCGC 300
ACCGAGCAGGGCGACAGCGCCATGTACCTGTGCGCCAGCAGCCCCCTGGA 350
GCGCGGCACCTACGAGCAGTACTTCGGCCCCGGCACCCGCCTGACCGTGA 400
CCGAGGACCTGAACAAGGTGTTCCCCCCCGAGGTGGCCGTGTTCGAGCCC 450
AGCGAGGCCGAGATCAGCCACACCCAGAAGGCCACCCTGGTGTGCCTGGC 500
CACCGGCTTCTTCCCCGACCACGTGGAGCTGAGCTGGTGGGTGAACGGCA 550
AGGAGGTGCACAGCGGCGTGTGCACCGACCCCCAGCCCCTGAAGGAGCAG 600
CCCGCCCTGAACGACAGCCGCTACTGCCTGAGCAGCCGCCTGCGCGTGAG 650
CGCCACCTTCTGGCAGAACCCCCGCAACCACTTCCGCTGCCAGGTGCAGT 700
TCTACGGCCTGAGCGAGAACGACGAGTGGACCCAGGACCGCGCCAAGCCC 750
GTGACCCAGATCGTGAGCGCCGAGGCCTGGGGCCGCGCCGACTGCGGCTT 800
CACCAGCGTGAGCTACCAGCAGGGCGTGCTGAGCGCCACCATCCTGTACG 850
AGATCCTGCTGGGCAAGGCCACCCTGTACGCCGTGCTGGTGAGCGCCCTG 900
GTGCTGATGGCCATGGTGAAGCGCAAGGACTTC [SEQ ID NO: 604]

FIG. 43

Donor B31 Clone 3 (TYG)

Alpha chain:

ATGCTGCTGATCACCAGCATGCTGGTGCTGTGGATGCAGCTGAGCCAGGT 50
GAACGGCCAGCAGGTGATGCAGATCCCCCAGTACCAGCACGTGCAGGAGG 100
GCGAGGACTTCACCACCTACTGCAACAGCAGCACCACCCTGAGCAACATC 150
CAGTGGTACAAGCAGCGCCCCGGCGGCCACCCCGTGTTCCTGATCCAGCT 200
GGTGAAGAGCGGCGAGGTGAAGAAGCAGAAGCGCCTGACCTTCCAGTTCG 250
GCGAGGCCAAGAAGAACAGCAGCCTGCACATCACCGCCACCCAGACCACC 300
GACGTGGGCACCTACTTCTGCGCCGGCGAGCGCGGCAGCACCCTGGGCCG 350
CCTGTACTTCGGCCGCGGCACCCAGCTGACCGTGTGGCCCGACATCCAGA 400
ACCCCGACCCCGCCGTGTACCAGCTGCGCGACAGCAAGAGCAGCGACAAG 450
AGCGTGTGCCTGTTCACCGACTTCGACAGCCAGACCAACGTGAGCCAGAG 500
CAAGGACAGCGACGTGTACATCACCGACAAGTGCGTGCTGGACATGCGCA 550
GCATGGACTTCAAGAGCAACAGCGCCGTGGCCTGGAGCAACAAGAGCGAC 600
TTCGCCTGCGCCAACGCCTTCAACAACAGCATCATCCCCGAGGACACCTT 650
CTTCCCCAGCCCCGAGAGCAGCTGCGACGTGAAGCTGGTGGAGAAGAGCT 700
TCGAGACCGACACCAACCTGAACTTCCAGAACCTGAGCGTGATCGGCTTC 750
CGCATCCTGCTGCTGAAGGTGGCCGGCTTCAACCTGCTGATGACCCTGCG 800
CCTGTGGAGCAGC [SEQ ID NO: 524]

Beta chain:

ATGGGCACCAGCCTGCTGTGCTGGATGGCCCTGTGCCTGCTGGGCGCCGA 50
CCACGCCGACACCGGCGTGAGCCAGAACCCCCGCCACAAGATCACCAAGC 100
GCGGCCAGAACGTGACCTTCCGCTGCGACCCCATCAGCGAGCACAACCGC 150
CTGTACTGGTACCGCCAGACCCTGGGCCAGGGCCCCGAGTTCCTGACCTA 200
CTTCCAGAACGAGGCCCAGCTGGAGAAGAGCCGCCTGCTGAGCGACCGCT 250
TCAGCGCCGAGCGCCCCAAGGGCAGCTTCAGCACCCTGGAGATCCAGCGC 300
ACCGAGCAGGGCGACAGCGCCATGTACCTGTGCGCCAGCAGCCTGCTGAG 350
CAGCGGCGACTACGAGCAGTACTTCGGCCCCGGCACCCGCCTGACCGTGA 400
CCGAGGACCTGAACAAGGTGTTCCCCCCCGAGGTGGCCGTGTTCGAGCCC 450
AGCGAGGCCGAGATCAGCCACACCCAGAAGGCCACCCTGGTGTGCCTGGC 500
CACCGGCTTCTTCCCCGACCACGTGGAGCTGAGCTGGTGGGTGAACGGCA 550
AGGAGGTGCACAGCGGCGTGTGCACCGACCCCCAGCCCCTGAAGGAGCAG 600
CCCGCCCTGAACGACAGCCGCTACTGCCTGAGCAGCCGCCTGCGCGTGAG 650
CGCCACCTTCTGGCAGAACCCCCGCAACCACTTCCGCTGCCAGGTGCAGT 700
TCTACGGCCTGAGCGAGAACGACGAGTGGACCCAGGACCGCGCCAAGCCC 750
GTGACCCAGATCGTGAGCGCCGAGGCCTGGGGCCGCGCCGACTGCGGCTT 800
CACCAGCGTGAGCTACCAGCAGGGCGTGCTGAGCGCCACCATCCTGTACG 850
AGATCCTGCTGGGCAAGGCCACCCTGTACGCCGTGCTGGTGAGCGCCCTG 900
GTGCTGATGGCCATGGTGAAGCGCAAGGACTTC [SEQ ID NO: 605]

FIG. 44

Donor B31 Clone 4 (TYG)

Alpha chain:

ATGACCAGCATCCGCGCCGTGTTCATCTTCCTGTGGCTGCAGCTGGACCT 50
GGTGAACGGCGAGAACGTGGAGCAGCACCCCAGCACCCTGAGCGTGCAGG 100
AGGGCGACAGCGCCGTGATCAAGTGCACCTACAGCGACAGCGCCAGCAAC 150
TACTTCCCCTGGTACAAGCAGGAGCTGGGCAAGCGCCCCCAGCTGATCAT 200
CGACATCCGCAGCAACGTGGGCGAGAAGAAGGACCAGCGCATCGCCGTGA 250
CCCTGAACAAGACCGCCAAGCACTTCAGCCTGCACATCACCGAGACCCAG 300
CCCGAGGACAGCGCCGTGTACTTCTGCGCCGCCCCCCGCGGCGCCGCCGG 350
CAACAAGCTGACCTTCGGCGGCGGCACCCGCGTGCTGGTGAAGCCCAACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 525]

Beta chain:

ATGAGCAACCAGGTGCTGTGCTGCGTGGTGCTGTGCTTCCTGGGCGCCAA 50
CACCGTGGACGGCGGCATCACCCAGAGCCCCAAGTACCTGTTCCGCAAGG 100
AGGGCCAGAACGTGACCCTGAGCTGCGAGCAGAACCTGAACCACGACGCC 150
ATGTACTGGTACCGCCAGGACCCCGGCCAGGGCCTGCGCCTGATCTACTA 200
CAGCCAGATCGTGAACGACTTCCAGAAGGGCGACATCGCCGAGGGCTACA 250
GCGTGAGCCGCGAGAAGAAGGAGAGCTTCCCCCTGACCGTGACCAGCGCC 300
CAGAAGAACCCCACCGCCTTCTACCTGTGCGCCAGCAGCAAGGGCGCCAG 350
CGGCATGCGCACCGAGCAGTACTTCGGCCCCGGCACCCGCCTGACCGTGA 400
CCGAGGACCTGAACAAGGTGTTCCCCCCCGAGGTGGCCGTGTTCGAGCCC 450
AGCGAGGCCGAGATCAGCCACACCCAGAAGGCCACCCTGGTGTGCCTGGC 500
CACCGGCTTCTTCCCCGACCACGTGGAGCTGAGCTGGTGGGTGAACGGCA 550
AGGAGGTGCACAGCGGCGTGTGCACCGACCCCCAGCCCCTGAAGGAGCAG 600
CCCGCCCTGAACGACAGCCGCTACTGCCTGAGCAGCCGCCTGCGCGTGAG 650
CGCCACCTTCTGGCAGAACCCCCGCAACCACTTCCGCTGCCAGGTGCAGT 700
TCTACGGCCTGAGCGAGAACGACGAGTGGACCCAGGACCGCGCCAAGCCC 750
GTGACCCAGATCGTGAGCGCCGAGGCCTGGGGCCGCGCCGACTGCGGCTT 800
CACCAGCGTGAGCTACCAGCAGGGCGTGCTGAGCGCCACCATCCTGTACG 850
AGATCCTGCTGGGCAAGGCCACCCTGTACGCCGTGCTGGTGAGCGCCCTG 900
GTGCTGATGGCCATGGTGAAGCGCAAGGACTTC [SEQ ID NO: 606]

FIG. 45

Donor B31 Clone 5 (TYG)

Alpha chain:

ATGCTGCTGATCACCAGCATGCTGGTGCTGTGGATGCAGCTGAGCCAGGT 50
GAACGGCCAGCAGGTGATGCAGATCCCCCAGTACCAGCACGTGCAGGAGG 100
GCGAGGACTTCACCACCTACTGCAACAGCAGCACCACCCTGAGCAACATC 150
CAGTGGTACAAGCAGCGCCCCGGCGGCCACCCCGTGTTCCTGATCCAGCT 200
GGTGAAGAGCGGCGAGGTGAAGAAGCAGAAGCGCCTGACCTTCCAGTTCG 250
GCGAGGCCAAGAAGAACAGCAGCCTGCACATCACCGCCACCCAGACCACC 300
GACGTGGGCACCTACTTCTGCGCCGGCGAGCGCGGCAGCACCCTGGGCCG 350
CCTGTACTTCGGCCGCGGCACCCAGCTGACCGTGTGGCCCGACATCCAGA 400
ACCCCGACCCCGCCGTGTACCAGCTGCGCGACAGCAAGAGCAGCGACAAG 450
AGCGTGTGCCTGTTCACCGACTTCGACAGCCAGACCAACGTGAGCCAGAG 500
CAAGGACAGCGACGTGTACATCACCGACAAGTGCGTGCTGGACATGCGCA 550
GCATGGACTTCAAGAGCAACAGCGCCGTGGCCTGGAGCAACAAGAGCGAC 600
TTCGCCTGCGCCAACGCCTTCAACAACAGCATCATCCCCGAGGACACCTT 650
CTTCCCCAGCCCCGAGAGCAGCTGCGACGTGAAGCTGGTGGAGAAGAGCT 700
TCGAGACCGACACCAACCTGAACTTCCAGAACCTGAGCGTGATCGGCTTC 750
CGCATCCTGCTGCTGAAGGTGGCCGGCTTCAACCTGCTGATGACCCTGCG 800
CCTGTGGAGCAGC [SEQ ID NO: 526]

Beta chain:

ATGGCCAGCCTGCTGTTCTTCTGCGGCGCCTTCTACCTGCTGGGCACCGG 50
CAGCATGGACGCCGACGTGACCCAGACCCCCCGCAACCGCATCACCAAGA 100
CCGGCAAGCGCATCATGCTGGAGTGCAGCCAGACCAAGGGCCACGACCGC 150
ATGTACTGGTACCGCCAGGACCCCGGCCTGGGCCTGCGCCTGATCTACTA 200
CAGCTTCGACGTGAAGGACATCAACAAGGGCGAGATCAGCGACGGCTACA 250
GCGTGAGCCGCCAGGCCCAGGCCAAGTTCAGCCTGAGCCTGGAGAGCGCC 300
ATCCCCAACCAGACCGCCCTGTACTTCTGCGCCACCAGCGACACCACCAG 350
CACCCGCCCCACCGAGCAGTACGTGGGCCCCGGCACCCGCCTGACCGTGA 400
CCGAGGACCTGAACAAGGTGTTCCCCCCCGAGGTGGCCGTGTTCGAGCCC 450
AGCGAGGCCGAGATCAGCCACACCCAGAAGGCCACCCTGGTGTGCCTGGC 500
CACCGGCTTCTTCCCCGACCACGTGGAGCTGAGCTGGTGGGTGAACGGCA 550
AGGAGGTGCACAGCGGCGTGTGCACCGACCCCCAGCCCCTGAAGGAGCAG 600
CCCGCCCTGAACGACAGCCGCTACTGCCTGAGCAGCCGCCTGCGCGTGAG 650
CGCCACCTTCTGGCAGAACCCCCGCAACCACTTCCGCTGCCAGGTGCAGT 700
TCTACGGCCTGAGCGAGAACGACGAGTGGACCCAGGACCGCGCCAAGCCC 750
GTGACCCAGATCGTGAGCGCCGAGGCCTGGGGCCGCGCCGACTGCGGCTT 800
CACCAGCGTGAGCTACCAGCAGGGCGTGCTGAGCGCCACCATCCTGTACG 850
AGATCCTGCTGGGCAAGGCCACCCTGTACGCCGTGCTGGTGAGCGCCCTG 900
GTGCTGATGGCCATGGTGAAGCGCAAGGACTTC [SEQ ID NO: 607]

FIG. 46

Donor B31 Clone 6 (TYG)

Alpha chain:

ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCGCCCTGCAGGGCGCCCAGAA 350
GCTGGTGTTCGGCCAGGGCACCCGCCTGACCATCAACCCCAACATCCAGA 400
ACCCCGACCCCGCCGTGTACCAGCTGCGCGACAGCAAGAGCAGCGACAAG 450
AGCGTGTGCCTGTTCACCGACTTCGACAGCCAGACCAACGTGAGCCAGAG 500
CAAGGACAGCGACGTGTACATCACCGACAAGTGCGTGCTGGACATGCGCA 550
GCATGGACTTCAAGAGCAACAGCGCCGTGGCCTGGAGCAACAAGAGCGAC 600
TTCGCCTGCGCCAACGCCTTCAACAACAGCATCATCCCCGAGGACACCTT 650
CTTCCCCAGCCCCGAGAGCAGCTGCGACGTGAAGCTGGTGGAGAAGAGCT 700
TCGAGACCGACACCAACCTGAACTTCCAGAACCTGAGCGTGATCGGCTTC 750
CGCATCCTGCTGCTGAAGGTGGCCGGCTTCAACCTGCTGATGACCCTGCG 800
CCTGTGGAGCAGC [SEQ ID NO: 527]

Beta chain:

ATGGACACCTGGCTGGTGTGCTGGGCCATCTTCAGCCTGCTGAAGGCCGG 50
CCTGACCGAGCCCGAGGTGACCCAGACCCCCAGCCACCAGGTGACCCAGA 100
TGGGCCAGGAGGTGATCCTGCGCTGCGTGCCCATCAGCAACCACCTGTAC 150
TTCTACTGGTACCGCCAGATCCTGGGCCAGAAGGTGGAGTTCCTGGTGAG 200
CTTCTACAACAACGAGATCAGCGAGAAGAGCGAGATCTTCGACGACCAGT 250
TCAGCGTGGAGCGCCCCGACGGCAGCAACTTCACCCTGAAGATCCGCAGC 300
ACCAAGCTGGAGGACAGCGCCATGTACTTCTGCGCCAGCAGCGCCACCAG 350
CGGCAGCTACAACGAGCAGTTCTTCGGCCCCGGCACCCGCCTGACCGTGC 400
TGGAGGACCTGAACAAGGTGTTCCCCCCCGAGGTGGCCGTGTTCGAGCCC 450
AGCGAGGCCGAGATCAGCCACACCCAGAAGGCCACCCTGGTGTGCCTGGC 500
CACCGGCTTCTTCCCCGACCACGTGGAGCTGAGCTGGTGGGTGAACGGCA 550
AGGAGGTGCACAGCGGCGTGTGCACCGACCCCCAGCCCCTGAAGGAGCAG 600
CCCGCCCTGAACGACAGCCGCTACTGCCTGAGCAGCCGCCTGCGCGTGAG 650
CGCCACCTTCTGGCAGAACCCCCGCAACCACTTCCGCTGCCAGGTGCAGT 700
TCTACGGCCTGAGCGAGAACGACGAGTGGACCCAGGACCGCGCCAAGCCC 750
GTGACCCAGATCGTGAGCGCCGAGGCCTGGGGCCGCGCCGACTGCGGCTT 800
CACCAGCGTGAGCTACCAGCAGGGCGTGCTGAGCGCCACCATCCTGTACG 850
AGATCCTGCTGGGCAAGGCCACCCTGTACGCCGTGCTGGTGAGCGCCCTG 900
GTGCTGATGGCCATGGTGAAGCGCAAGGACTTC [SEQ ID NO: 608]

FIG. 47

Donor Y6W Clone 1 (TYG)

Alpha chain:

ATGCGCCAGGTGGCCCGCGTGATCGTGTTCCTGACCCTGAGCACCCTGAG 50
CCTGGCCAAGACCACCCAGCCCATCAGCATGGACAGCTACGAGGGCCAGG 100
AGGTGAACATCACCTGCAGCCACAACAACATCGCCACCAACGACTACATC 150
ACCTGGTACCAGCAGTTCCCCAGCCAGGGCCCCCGCTTCATCATCCAGGG 200
CTACAAGACCAAGGTGACCAACGAGGTGGCCAGCCTGTTCATCCCCGCCG 250
ACCGCAAGAGCAGCACCCTGAGCCTGCCCCGCGTGAGCCTGAGCGACACC 300
GCCGTGTACTACTGCCTGGTGGTGCCCTTCGGCGGCTACAACAAGCTGAT 350
CTTCGGCGCCGGCACCCGCCTGGCCGTGCACCCCTACATCCAGAACCCCG 400
ACCCCGCCGTGTACCAGCTGCGCGACAGCAAGAGCAGCGACAAGAGCGTG 450
TGCCTGTTCACCGACTTCGACAGCCAGACCAACGTGAGCCAGAGCAAGGA 500
CAGCGACGTGTACATCACCGACAAGTGCGTGCTGGACATGCGCAGCATGG 550
ACTTCAAGAGCAACAGCGCCGTGGCCTGGAGCAACAAGAGCGACTTCGCC 600
TGCGCCAACGCCTTCAACAACAGCATCATCCCCGAGGACACCTTCTTCCC 650
CAGCCCCGAGAGCAGCTGCGACGTGAAGCTGGTGGAGAAGAGCTTCGAGA 700
CCGACACCAACCTGAACTTCCAGAACCTGAGCGTGATCGGCTTCCGCATC 750
CTGCTGCTGAAGGTGGCCGGCTTCAACCTGCTGATGACCCTGCGCCTGTG 800
GAGCAGC [SEQ ID NO: 528]

Beta chain:

ATGCTGAGCCTGCTGCTGCTGCTGCTGGGCCTGGGCAGCGTGTTCAGCGC 50
CGTGATCAGCCAGAAGCCCAGCCGCGACATCTGCCAGCGCGGCACCAGCC 100
TGACCATCCAGTGCCAGGTGGACAGCCAGGTGACCATGATGTTCTGGTAC 150
CGCCAGCAGCCCGGCCAGAGCCTGACCCTGATCGCCACCGCCAACCAGGG 200
CAGCGAGGCCACCTACGAGAGCGGCTTCGTGATCGACAAGTTCCCCATCA 250
GCCGCCCCAACCTGACCTTCAGCACCCTGACCGTGAGCAACATGAGCCCC 300
GAGGACAGCAGCATCTACCTGTGCAGCGTGGGCGAGGGCACCAGCGGCTA 350
CGAGAGCTACAACGAGCAGTTCTTCGGCCCCGGCACCCGCCTGACCGTGC 400
TGGAGGACCTGAACAAGGTGTTCCCCCCCGAGGTGGCCGTGTTCGAGCCC 450
AGCGAGGCCGAGATCAGCCACACCCAGAAGGCCACCCTGGTGTGCCTGGC 500
CACCGGCTTCTTCCCCGACCACGTGGAGCTGAGCTGGTGGGTGAACGGCA 550
AGGAGGTGCACAGCGGCGTGTGCACCGACCCCCAGCCCCTGAAGGAGCAG 600
CCCGCCCTGAACGACAGCCGCTACTGCCTGAGCAGCCGCCTGCGCGTGAG 650
CGCCACCTTCTGGCAGAACCCCCGCAACCACTTCCGCTGCCAGGTGCAGT 700
TCTACGGCCTGAGCGAGAACGACGAGTGGACCCAGGACCGCGCCAAGCCC 750
GTGACCCAGATCGTGAGCGCCGAGGCCTGGGGCCGCGCCGACTGCGGCTT 800
CACCAGCGTGAGCTACCAGCAGGGCGTGCTGAGCGCCACCATCCTGTACG 850
AGATCCTGCTGGGCAAGGCCACCCTGTACGCCGTGCTGGTGAGCGCCCTG 900
GTGCTGATGGCCATGGTGAAGCGCAAGGACTTC [SEQ ID NO: 609]

FIG. 48

Donor Y6W Clone 2 (TYG)

Alpha chain:

ATGCTGCTGATCACCAGCATGCTGGTGCTGTGGATGCAGCTGAGCCAGGT 50
GAACGGCCAGCAGGTGATGCAGATCCCCCAGTACCAGCACGTGCAGGAGG 100
GCGAGGACTTCACCACCTACTGCAACAGCAGCACCACCCTGAGCAACATC 150
CAGTGGTACAAGCAGCGCCCCGGCGGCCACCCCGTGTTCCTGATCCAGCT 200
GGTGAAGAGCGGCGAGGTGAAGAAGCAGAAGCGCCTGACCTTCCAGTTCG 250
GCGAGGCCAAGAAGAACAGCAGCCTGCACATCACCGCCACCCAGACCACC 300
GACGTGGGCACCTACTTCTGCGCCGGCGAGCGCGGCAGCACCCTGGGCCG 350
CCTGTACTTCGGCCGCGGCACCCAGCTGACCGTGTGGCCCGACATCCAGA 400
ACCCCGACCCCGCCGTGTACCAGCTGCGCGACAGCAAGAGCAGCGACAAG 450
AGCGTGTGCCTGTTCACCGACTTCGACAGCCAGACCAACGTGAGCCAGAG 500
CAAGGACAGCGACGTGTACATCACCGACAAGTGCGTGCTGGACATGCGCA 550
GCATGGACTTCAAGAGCAACAGCGCCGTGGCCTGGAGCAACAAGAGCGAC 600
TTCGCCTGCGCCAACGCCTTCAACAACAGCATCATCCCCGAGGACACCTT 650
CTTCCCCAGCCCCGAGAGCAGCTGCGACGTGAAGCTGGTGGAGAAGAGCT 700
TCGAGACCGACACCAACCTGAACTTCCAGAACCTGAGCGTGATCGGCTTC 750
CGCATCCTGCTGCTGAAGGTGGCCGGCTTCAACCTGCTGATGACCCTGCG 800
CCTGTGGAGCAGC [SEQ ID NO: 529]

Beta chain:

ATGGGCACCAGCCTGCTGTGCTGGATGGCCCTGTGCCTGCTGGGCGCCGA 50
CCACGCCGACACCGGCGTGAGCCAGAACCCCCGCCACAAGATCACCAAGC 100
GCGGCCAGAACGTGACCTTCCGCTGCGACCCCATCAGCGAGCACAACCGC 150
CTGTACTGGTACCGCCAGACCCTGGGCCAGGGCCCCGAGTTCCTGACCTA 200
CTTCCAGAACGAGGCCCAGCTGGAGAAGAGCCGCCTGCTGAGCGACCGCT 250
TCAGCGCCGAGCGCCCCAAGGGCAGCTTCAGCACCCTGGAGATCCAGCGC 300
ACCGAGCAGGGCGACAGCGCCATGTACCTGTGCGCCAGCAGCAGCCTGGA 350
CCGCGGCGACTACGAGCAGTACTTCGGCCCCGGCACCCGCCTGACCGTGA 400
CCGAGGACCTGAACAAGGTGTTCCCCCCCGAGGTGGCCGTGTTCGAGCCC 450
AGCGAGGCCGAGATCAGCCACACCCAGAAGGCCACCCTGGTGTGCCTGGC 500
CACCGGCTTCTTCCCCGACCACGTGGAGCTGAGCTGGTGGGTGAACGGCA 550
AGGAGGTGCACAGCGGCGTGTGCACCGACCCCCAGCCCCTGAAGGAGCAG 600
CCCGCCCTGAACGACAGCCGCTACTGCCTGAGCAGCCGCCTGCGCGTGAG 650
CGCCACCTTCTGGCAGAACCCCCGCAACCACTTCCGCTGCCAGGTGCAGT 700
TCTACGGCCTGAGCGAGAACGACGAGTGGACCCAGGACCGCGCCAAGCCC 750
GTGACCCAGATCGTGAGCGCCGAGGCCTGGGGCCGCGCCGACTGCGGCTT 800
CACCAGCGTGAGCTACCAGCAGGGCGTGCTGAGCGCCACCATCCTGTACG 850
AGATCCTGCTGGGCAAGGCCACCCTGTACGCCGTGCTGGTGAGCGCCCTG 900
GTGCTGATGGCCATGGTGAAGCGCAAGGACTTC [SEQ ID NO: 610]

FIG. 49

Donor Y6W Clone 3 (TYG)

Alpha chain:
ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCCCCGACCGCCCCGACACCGA 350
CAAGCTGATCTTCGGCACCGGCACCCGCCTGCAGGTGTTCCCCAACATCC 400
AGAACCCCGACCCCGCCGTGTACCAGCTGCGCGACAGCAAGAGCAGCGAC 450
AAGAGCGTGTGCCTGTTCACCGACTTCGACAGCCAGACCAACGTGAGCCA 500
GAGCAAGGACAGCGACGTGTACATCACCGACAAGTGCGTGCTGGACATGC 550
GCAGCATGGACTTCAAGAGCAACAGCGCCGTGGCCTGGAGCAACAAGAGC 600
GACTTCGCCTGCGCCAACGCCTTCAACAACAGCATCATCCCCGAGGACAC 650
CTTCTTCCCCAGCCCCGAGAGCAGCTGCGACGTGAAGCTGGTGGAGAAGA 700
GCTTCGAGACCGACACCAACCTGAACTTCCAGAACCTGAGCGTGATCGGC 750
TTCCGCATCCTGCTGCTGAAGGTGGCCGGCTTCAACCTGCTGATGACCCT 800
GCGCCTGTGGAGCAGC [SEQ ID NO: 530]

Beta chain:
ATGGGCACCAGCCTGCTGTGCTGGATGGCCCTGTGCCTGCTGGGCGCCGA 50
CCACGCCGACACCGGCGTGAGCCAGAACCCCCGCCACAAGATCACCAAGC 100
GCGGCCAGAACGTGACCTTCCGCTGCGACCCCATCAGCGAGCACAACCGC 150
CTGTACTGGTACCGCCAGACCCTGGGCCAGGGCCCCGAGTTCCTGACCTA 200
CTTCCAGAACGAGGCCCAGCTGGAGAAGAGCCGCCTGCTGAGCGACCGCT 250
TCAGCGCCGAGCGCCCCAAGGGCAGCTTCAGCACCCTGGAGATCCAGCGC 300
ACCGAGCAGGGCGACAGCGCCATGTACCTGTGCGCCAGCCAGAACCGCCG 350
CGAGGGCCGCAGCGAGCAGTTCTTCGGCCCCGGCACCCGCCTGACCGTGC 400
TGGAGGACCTGAACAAGGTGTTCCCCCCCGAGGTGGCCGTGTTCGAGCCC 450
AGCGAGGCCGAGATCAGCCACACCCAGAAGGCCACCCTGGTGTGCCTGGC 500
CACCGGCTTCTTCCCCGACCACGTGGAGCTGAGCTGGTGGGTGAACGGCA 550
AGGAGGTGCACAGCGGCGTGTGCACCGACCCCCAGCCCCTGAAGGAGCAG 600
CCCGCCCTGAACGACAGCCGCTACTGCCTGAGCAGCCGCCTGCGCGTGAG 650
CGCCACCTTCTGGCAGAACCCCCGCAACCACTTCCGCTGCCAGGTGCAGT 700
TCTACGGCCTGAGCGAGAACGACGAGTGGACCCAGGACCGCGCCAAGCCC 750
GTGACCCAGATCGTGAGCGCCGAGGCCTGGGGCCGCGCCGACTGCGGCTT 800
CACCAGCGTGAGCTACCAGCAGGGCGTGCTGAGCGCCACCATCCTGTACG 850
AGATCCTGCTGGGCAAGGCCACCCTGTACGCCGTGCTGGTGAGCGCCCTG 900
GTGCTGATGGCCATGGTGAAGCGCAAGGACTTC [SEQ ID NO: 611]

FIG. 50

TCRs specific for HLA-A*24:02-PYLFWLAAI

Donor B33 Clone 1 (PYL)

Alpha chain:

ATGCTGCTGATCACCAGCATGCTGGTGCTGTGGATGCAGCTGAGCCAGGT 50
GAACGGCCAGCAGGTGATGCAGATCCCCCAGTACCAGCACGTGCAGGAGG 100
GCGAGGACTTCACCACCTACTGCAACAGCAGCACCACCCTGAGCAACATC 150
CAGTGGTACAAGCAGCGCCCCGGCGGCCACCCCGTGTTCCTGATCCAGCT 200
GGTGAAGAGCGGCGAGGTGAAGAAGCAGAAGCGCCTGACCTTCCAGTTCG 250
GCGAGGCCAAGAAGAACAGCAGCCTGCACATCACCGCCACCCAGACCACC 300
GACGTGGGCACCTACTTCTGCGCCGGCCCCGGCACCGGCGCCGGCAGCTA 350
CCAGCTGACCTTCGGCAAGGGCACCAAGCTGAGCGTGATCCCCAACATCC 400
AGAACCCCGACCCCGCCGTGTACCAGCTGCGCGACAGCAAGAGCAGCGAC 450
AAGAGCGTGTGCCTGTTCACCGACTTCGACAGCCAGACCAACGTGAGCCA 500
GAGCAAGGACAGCGACGTGTACATCACCGACAAGTGCGTGCTGGACATGC 550
GCAGCATGGACTTCAAGAGCAACAGCGCCGTGGCCTGGAGCAACAAGAGC 600
GACTTCGCCTGCGCCAACGCCTTCAACAACAGCATCATCCCCGAGGACAC 650
CTTCTTCCCCAGCCCCGAGAGCAGCTGCGACGTGAAGCTGGTGGAGAAGA 700
GCTTCGAGACCGACACCAACCTGAACTTCCAGAACCTGAGCGTGATCGGC 750
TTCCGCATCCTGCTGCTGAAGGTGGCCGGCTTCAACCTGCTGATGACCCT 800
GCGCCTGTGGAGCAGC [SEQ ID NO: 531]

Beta chain:

ATGGGCATCCGCCTGCTGTGCCGCGTGGCCTTCTGCTTCCTGGCCGTGGG 50
CCTGGTGGACGTGAAGGTGACCCAGAGCAGCCGCTACCTGGTGAAGCGCA 100
CCGGCGAGAAGGTGTTCCTGGAGTGCGTGCAGGACATGGACCACGAGAAC 150
ATGTTCTGGTACCGCCAGGACCCCGGCCTGGGCCTGCGCCTGATCTACTT 200
CAGCTACGACGTGAAGATGAAGGAGAAGGGCGACATCCCCGAGGGCTACA 250
GCGTGAGCCGCGAGAAGAAGGAGCGCTTCAGCCTGATCCTGGAGAGCGCC 300
AGCACCAACCAGACCAGCATGTACCTGTGCGCCAGCATCAAGAGCAGCGG 350
CTACAACGAGCAGTTCTTCGGCCCCGGCACCCGCCTGACCGTGCTGGAGG 400
ACCTGAACAAGGTGTTCCCCCCCGAGGTGGCCGTGTTCGAGCCCAGCGAG 450
GCCGAGATCAGCCACACCCAGAAGGCCACCCTGGTGTGCCTGGCCACCGG 500
CTTCTTCCCCGACCACGTGGAGCTGAGCTGGTGGGTGAACGGCAAGGAGG 550
TGCACAGCGGCGTGTGCACCGACCCCCAGCCCCTGAAGGAGCAGCCCGCC 600
CTGAACGACAGCCGCTACTGCCTGAGCAGCCGCCTGCGCGTGAGCGCCAC 650
CTTCTGGCAGAACCCCCGCAACCACTTCCGCTGCCAGGTGCAGTTCTACG 700
GCCTGAGCGAGAACGACGAGTGGACCCAGGACCGCGCCAAGCCCGTGACC 750
CAGATCGTGAGCGCCGAGGCCTGGGGCCGCGCCGACTGCGGCTTCACCAG 800
CGTGAGCTACCAGCAGGGCGTGCTGAGCGCCACCATCCTGTACGAGATCC 850
TGCTGGGCAAGGCCACCCTGTACGCCGTGCTGGTGAGCGCCCTGGTGCTG 900
ATGGCCATGGTGAAGCGCAAGGACTTC [SEQ ID NO: 612]

FIG. 51

Donor B5F Clone 1 (PYL)

Alpha chain:

ATGCTGCTGATCACCAGCATGCTGGTGCTGTGGATGCAGCTGAGCCAGGT 50
GAACGGCCAGCAGGTGATGCAGATCCCCCAGTACCAGCACGTGCAGGAGG 100
GCGAGGACTTCACCACCTACTGCAACAGCAGCACCACCCTGAGCAACATC 150
CAGTGGTACAAGCAGCGCCCCGGCGGCCACCCCGTGTTCCTGATCCAGCT 200
GGTGAAGAGCGGCGAGGTGAAGAAGCAGAAGCGCCTGACCTTCCAGTTCG 250
GCGAGGCCAAGAAGAACAGCAGCCTGCACATCACCGCCACCCAGACCACC 300
GACGTGGGCACCTACTTCTGCGCCGGCCCCTACAGCGGCGCCGGCAGCTA 350
CCAGCTGACCTTCGGCAAGGGCACCAAGCTGAGCGTGATCCCCAACATCC 400
AGAACCCCGACCCCGCCGTGTACCAGCTGCGCGACAGCAAGAGCAGCGAC 450
AAGAGCGTGTGCCTGTTCACCGACTTCGACAGCCAGACCAACGTGAGCCA 500
GAGCAAGGACAGCGACGTGTACATCACCGACAAGTGCGTGCTGGACATGC 550
GCAGCATGGACTTCAAGAGCAACAGCGCCGTGGCCTGGAGCAACAAGAGC 600
GACTTCGCCTGCGCCAACGCCTTCAACAACAGCATCATCCCCGAGGACAC 650
CTTCTTCCCCAGCCCCGAGAGCAGCTGCGACGTGAAGCTGGTGGAGAAGA 700
GCTTCGAGACCGACACCAACCTGAACTTCCAGAACCTGAGCGTGATCGGC 750
TTCCGCATCCTGCTGCTGAAGGTGGCCGGCTTCAACCTGCTGATGACCCT 800
GCGCCTGTGGAGCAGC [SEQ ID NO: 532]

Beta chain:

ATGGGCATCCGCCTGCTGTGCCGCGTGGCCTTCTGCTTCCTGGCCGTGGG 50
CCTGGTGGACGTGAAGGTGACCCAGAGCAGCCGCTACCTGGTGAAGCGCA 100
CCGGCGAGAAGGTGTTCCTGGAGTGCGTGCAGGACATGGACCACGAGAAC 150
ATGTTCTGGTACCGCCAGGACCCCGGCCTGGGCCTGCGCCTGATCTACTT 200
CAGCTACGACGTGAAGATGAAGGAGAAGGGCGACATCCCCGAGGGCTACA 250
GCGTGAGCCGCGAGAAGAAGGAGCGCTTCAGCCTGATCCTGGAGAGCGCC 300
AGCACCAACCAGACCAGCATGTACCTGTGCGCCAGCATCCTGAGCAGCGG 350
CTACAACGAGCAGTTCTTCGGCCCCGGCACCCGCCTGACCGTGCTGGAGG 400
ACCTGAACAAGGTGTTCCCCCCCGAGGTGGCCGTGTTCGAGCCCAGCGAG 450
GCCGAGATCAGCCACACCCAGAAGGCCACCCTGGTGTGCCTGGCCACCGG 500
CTTCTTCCCCGACCACGTGGAGCTGAGCTGGTGGGTGAACGGCAAGGAGG 550
TGCACAGCGGCGTGTGCACCGACCCCCAGCCCCTGAAGGAGCAGCCCGCC 600
CTGAACGACAGCCGCTACTGCCTGAGCAGCCGCCTGCGCGTGAGCGCCAC 650
CTTCTGGCAGAACCCCCGCAACCACTTCCGCTGCCAGGTGCAGTTCTACG 700
GCCTGAGCGAGAACGACGAGTGGACCCAGGACCGCGCCAAGCCCGTGACC 750
CAGATCGTGAGCGCCGAGGCCTGGGGCCGCGCCGACTGCGGCTTCACCAG 800
CGTGAGCTACCAGCAGGGCGTGCTGAGCGCCACCATCCTGTACGAGATCC 850
TGCTGGGCAAGGCCACCCTGTACGCCGTGCTGGTGAGCGCCCTGGTGCTG 900
ATGGCCATGGTGAAGCGCAAGGACTTC [SEQ ID NO: 613]

FIG. 52

Donor Y6W Clone 1 (PYL)

Alpha chain:

ATGCGCCAGGTGGCCCGCGTGATCGTGTTCCTGACCCTGAGCACCCTGAG 50
CCTGGCCAAGACCACCCAGCCCATCAGCATGGACAGCTACGAGGGCCAGG 100
AGGTGAACATCACCTGCAGCCACAACAACATCGCCACCAACGACTACATC 150
ACCTGGTACCAGCAGTTCCCCAGCCAGGGCCCCCGCTTCATCATCCAGGG 200
CTACAAGACCAAGGTGACCAACGAGGTGGCCAGCCTGTTCATCCCCGCCG 250
ACCGCAAGAGCAGCACCCTGAGCCTGCCCCGCGTGAGCCTGAGCGACACC 300
GCCGTGTACTACTGCCTGGTGGTGCCCTTCGGCGGCTACAACAAGCTGAT 350
CTTCGGCGCCGGCACCCGCCTGGCCGTGCACCCCTACATCCAGAACCCCG 400
ACCCCGCCGTGTACCAGCTGCGCGACAGCAAGAGCAGCGACAAGAGCGTG 450
TGCCTGTTCACCGACTTCGACAGCCAGACCAACGTGAGCCAGAGCAAGGA 500
CAGCGACGTGTACATCACCGACAAGTGCGTGCTGGACATGCGCAGCATGG 550
ACTTCAAGAGCAACAGCGCCGTGGCCTGGAGCAACAAGAGCGACTTCGCC 600
TGCGCCAACGCCTTCAACAACAGCATCATCCCCGAGGACACCTTCTTCCC 650
CAGCCCCGAGAGCAGCTGCGACGTGAAGCTGGTGGAGAAGAGCTTCGAGA 700
CCGACACCAACCTGAACTTCCAGAACCTGAGCGTGATCGGCTTCCGCATC 750
CTGCTGCTGAAGGTGGCCGGCTTCAACCTGCTGATGACCCTGCGCCTGTG 800
GAGCAGC [SEQ ID NO: 533]

Beta chain:

ATGCTGAGCCTGCTGCTGCTGCTGCTGGGCCTGGGCAGCGTGTTCAGCGC 50
CGTGATCAGCCAGAAGCCCAGCCGCGACATCTGCCAGCGCGGCACCAGCC 100
TGACCATCCAGTGCCAGGTGGACAGCCAGGTGACCATGATGTTCTGGTAC 150
CGCCAGCAGCCCGGCCAGAGCCTGACCCTGATCGCCACCGCCAACCAGGG 200
CAGCGAGGCCACCTACGAGAGCGGCTTCGTGATCGACAAGTTCCCCATCA 250
GCCGCCCCAACCTGACCTTCAGCACCCTGACCGTGAGCAACATGAGCCCC 300
GAGGACAGCAGCATCTACCTGTGCAGCGTGGGCGAGGGCACCAGCGGCTA 350
CGAGAGCTACAACGAGCAGTTCTTCGGCCCCGGCACCCGCCTGACCGTGC 400
TGGAGGACCTGAACAAGGTGTTCCCCCCCGAGGTGGCCGTGTTCGAGCCC 450
AGCGAGGCCGAGATCAGCCACACCCAGAAGGCCACCCTGGTGTGCCTGGC 500
CACCGGCTTCTTCCCCGACCACGTGGAGCTGAGCTGGTGGGTGAACGGCA 550
AGGAGGTGCACAGCGGCGTGTGCACCGACCCCCAGCCCCTGAAGGAGCAG 600
CCCGCCCTGAACGACAGCCGCTACTGCCTGAGCAGCCGCCTGCGCGTGAG 650
CGCCACCTTCTGGCAGAACCCCCGCAACCACTTCCGCTGCCAGGTGCAGT 700
TCTACGGCCTGAGCGAGAACGACGAGTGGACCCAGGACCGCGCCAAGCCC 750
GTGACCCAGATCGTGAGCGCCGAGGCCTGGGGCCGCGCCGACTGCGGCTT 800
CACCAGCGTGAGCTACCAGCAGGGCGTGCTGAGCGCCACCATCCTGTACG 850
AGATCCTGCTGGGCAAGGCCACCCTGTACGCCGTGCTGGTGAGCGCCCTG 900
GTGCTGATGGCCATGGTGAAGCGCAAGGACTTC [SEQ ID NO: 614]

FIG. 53

Donor Y6W Clone 2 (PYL)

Alpha chain:
ATGAAGAGCCTGCGCGTGCTGCTGGTGATCCTGTGGCTGCAGCTGAGCTG 50
GGTGTGGAGCCAGCAGAAGGAGGTGGAGCAGAACAGCGGCCCCCTGAGCG 100
TGCCCGAGGGCGCCATCGCCAGCCTGAACTGCACCTACAGCGACCGCGGC 150
AGCCAGAGCTTCTTCTGGTACCGCCAGTACAGCGGCAAGAGCCCCGAGCT 200
GATCATGTTCATCTACAGCAACGGCGACAAGGAGGACGGCCGCTTCACCG 250
CCCAGCTGAACAAGGCCAGCCAGTACGTGAGCCTGCTGATCCGCGACAGC 300
CAGCCCAGCGACAGCGCCACCTACCTGTGCGCCGTGAACGTGGGCAACAC 350
CGGCTTCCAGAAGCTGGTGTTCGGCACCGGCACCCGCCTGCTGGTGAGCC 400
CCAACATCCAGAACCCCGACCCCGCCGTGTACCAGCTGCGCGACAGCAAG 450
AGCAGCGACAAGAGCGTGTGCCTGTTCACCGACTTCGACAGCCAGACCAA 500
CGTGAGCCAGAGCAAGGACAGCGACGTGTACATCACCGACAAGTGCGTGC 550
TGGACATGCGCAGCATGGACTTCAAGAGCAACAGCGCCGTGGCCTGGAGC 600
AACAAGAGCGACTTCGCCTGCGCCAACGCCTTCAACAACAGCATCATCCC 650
CGAGGACACCTTCTTCCCCAGCCCCGAGAGCAGCTGCGACGTGAAGCTGG 700
TGGAGAAGAGCTTCGAGACCGACACCAACCTGAACTTCCAGAACCTGAGC 750
GTGATCGGCTTCCGCATCCTGCTGCTGAAGGTGGCCGGCTTCAACCTGCT 800
GATGACCCTGCGCCTGTGGAGCAGC [SEQ ID NO: 534]

Beta chain:
ATGCTGTGCAGCCTGCTGGCCCTGCTGCTGGGCACCTTCTTCGGCGTGCG 50
CAGCCAGACCATCCACCAGTGGCCCGCCACCCTGGTGCAGCCCGTGGGCA 100
GCCCCCTGAGCCTGGAGTGCACCGTGGAGGGCACCAGCAACCCCAACCTG 150
TACTGGTACCGCCAGGCCGCCGGCCGCGGCCTGCAGCTGCTGTTCTACAG 200
CGTGGGCATCGGCCAGATCAGCAGCGAGGTGCCCCAGAACCTGAGCGCCA 250
GCCGCCCCCAGGACCGCCAGTTCATCCTGAGCAGCAAGAAGCTGCTGCTG 300
AGCGACAGCGGCTTCTACCTGTGCGCCTGCCAGTGGCAGGGCCTGGGCGG 350
CGAGCTGTTCTTCGGCGAGGGCAGCCGCCTGACCGTGCTGGAGGACCTGA 400
ACAAGGTGTTCCCCCCCGAGGTGGCCGTGTTCGAGCCCAGCGAGGCCGAG 450
ATCAGCCACACCCAGAAGGCCACCCTGGTGTGCCTGGCCACCGGCTTCTT 500
CCCCGACCACGTGGAGCTGAGCTGGTGGGTGAACGGCAAGGAGGTGCACA 550
GCGGCGTGTGCACCGACCCCCAGCCCCTGAAGGAGCAGCCCGCCCTGAAC 600
GACAGCCGCTACTGCCTGAGCAGCCGCCTGCGCGTGAGCGCCACCTTCTG 650
GCAGAACCCCCGCAACCACTTCCGCTGCCAGGTGCAGTTCTACGGCCTGA 700
GCGAGAACGACGAGTGGACCCAGGACCGCGCCAAGCCCGTGACCCAGATC 750
GTGAGCGCCGAGGCCTGGGGCCGCGCCGACTGCGGCTTCACCAGCGTGAG 800
CTACCAGCAGGGCGTGCTGAGCGCCACCATCCTGTACGAGATCCTGCTGG 850
GCAAGGCCACCCTGTACGCCGTGCTGGTGAGCGCCCTGGTGCTGATGGCC 900
ATGGTGAAGCGCAAGGACTTC [SEQ ID NO: 615]

FIG. 54

Donor Y6W Clone 3 (PYL)

Alpha chain:

ATGACCAGCATCCGCGCCGTGTTCATCTTCCTGTGGCTGCAGCTGGACCT 50
GGTGAACGGCGAGAACGTGGAGCAGCACCCCAGCACCCTGAGCGTGCAGG 100
AGGGCGACAGCGCCGTGATCAAGTGCACCTACAGCGACAGCGCCAGCAAC 150
TACTTCCCCTGGTACAAGCAGGAGCTGGGCAAGGGCCCCCAGCTGATCAT 200
CGACATCCGCAGCAACGTGGGCGAGAAGAAGGACCAGCGCATCGCCGTGA 250
CCCTGAACAAGACCGCCAAGCACTTCAGCCTGCACATCACCGAGACCCAG 300
CCCGAGGACAGCGCCGTGTACTTCTGCGCCGCCAGCGAGTTCCAGTTCTA 350
CTTCGGCACCGGCACCAGCCTGACCGTGATCCCCAACATCCAGAACCCCG 400
ACCCCGCCGTGTACCAGCTGCGCGACAGCAAGAGCAGCGACAAGAGCGTG 450
TGCCTGTTCACCGACTTCGACAGCCAGACCAACGTGAGCCAGAGCAAGGA 500
CAGCGACGTGTACATCACCGACAAGTGCGTGCTGGACATGCGCAGCATGG 550
ACTTCAAGAGCAACAGCGCCGTGGCCTGGAGCAACAAGAGCGACTTCGCC 600
TGCGCCAACGCCTTCAACAACAGCATCATCCCCGAGGACACCTTCTTCCC 650
CAGCCCCGAGAGCAGCTGCGACGTGAAGCTGGTGGAGAAGAGCTTCGAGA 700
CCGACACCAACCTGAACTTCCAGAACCTGAGCGTGATCGGCTTCCGCATC 750
CTGCTGCTGAAGGTGGCCGGCTTCAACCTGCTGATGACCCTGCGCCTGTG 800
GAGCAGC [SEQ ID NO: 535]

Beta chain:

ATGGGCTTCCGCCTGCTGTGCTGCGTGGCCTTCTGCCTGCTGGGCGCCGG 50
CCCCGTGGACAGCGGCGTGACCCAGACCCCCAAGCACCTGATCACCGCCA 100
CCGGCCAGCGCGTGACCCTGCGCTGCAGCCCCCGCAGCGGCGACCTGAGC 150
GTGTACTGGTACCAGCAGAGCCTGGACCAGGGCCTGCAGTTCCTGATCCA 200
GTACTACAACGGCGAGGAGCGCGCCAAGGGCAACATCCTGGAGCGCTTCA 250
GCGCCCAGCAGTTCCCCGACCTGCACAGCGAGCTGAACCTGAGCAGCCTG 300
GAGCTGGGCGACAGCGCCCTGTACTTCTGCGCCAGCAGCCCCGGCCAGCG 350
CGCCAACACCGGCGAGCTGTTCTTCGGCGAGGGCAGCCGCCTGACCGTGC 400
TGGAGGACCTGAACAAGGTGTTCCCCCCCGAGGTGGCCGTGTTCGAGCCC 450
AGCGAGGCCGAGATCAGCCACACCCAGAAGGCCACCCTGGTGTGCCTGGC 500
CACCGGCTTCTTCCCCGACCACGTGGAGCTGAGCTGGTGGGTGAACGGCA 550
AGGAGGTGCACAGCGGCGTGTGCACCGACCCCCAGCCCCTGAAGGAGCAG 600
CCCGCCCTGAACGACAGCCGCTACTGCCTGAGCAGCCGCCTGCGCGTGAG 650
CGCCACCTTCTGGCAGAACCCCCGCAACCACTTCCGCTGCCAGGTGCAGT 700
TCTACGGCCTGAGCGAGAACGACGAGTGGACCCAGGACCGCGCCAAGCCC 750
GTGACCCAGATCGTGAGCGCCGAGGCCTGGGGCCGCGCCGACTGCGGCTT 800
CACCAGCGTGAGCTACCAGCAGGGCGTGCTGAGCGCCACCATCCTGTACG 850
AGATCCTGCTGGGCAAGGCCACCCTGTACGCCGTGCTGGTGAGCGCCCTG 900
GTGCTGATGGCCATGGTGAAGCGCAAGGACTTC [SEQ ID NO: 616]

FIG. 55

Donor Y6W Clone 4 (PYL)

Alpha chain:

ATGAGCCTGAGCAGCCTGCTGAAGGTGGTGACCGCCAGCCTGTGGCTGGG 50
CCCCGGCATCGCCCAGAAGATCACCCAGACCCAGCCCGGCATGTTCGTGC 100
AGGAGAAGGAGGCCGTGACCCTGGACTGCACCTACGACACCAGCGACCCC 150
AGCTACGGCCTGTTCTGGTACAAGCAGCCCAGCAGCGGCGAGATGATCTT 200
CCTGATCTACCAGGGCAGCTACGACCAGCAGAACGCCACCGAGGGCCGCT 250
ACAGCCTGAACTTCCAGAAGGCCCGCAAGAGCGCCAACCTGGTGATCAGC 300
GCCAGCCAGCTGGGCGACAGCGCCATGTACTTCTGCGCCATGCGCGAGGG 350
CGTGGACTACCAGCTGATCTGGGGCGCCGGCACCAAGCTGATCATCAAGC 400
CCGACATCCAGAACCCCGACCCCGCCGTGTACCAGCTGCGCGACAGCAAG 450
AGCAGCGACAAGAGCGTGTGCCTGTTCACCGACTTCGACAGCCAGACCAA 500
CGTGAGCCAGAGCAAGGACAGCGACGTGTACATCACCGACAAGTGCGTGC 550
TGGACATGCGCAGCATGGACTTCAAGAGCAACAGCGCCGTGGCCTGGAGC 600
AACAAGAGCGACTTCGCCTGCGCCAACGCCTTCAACAACAGCATCATCCC 650
CGAGGACACCTTCTTCCCCAGCCCCGAGAGCAGCTGCGACGTGAAGCTGG 700
TGGAGAAGAGCTTCGAGACCGACACCAACCTGAACTTCCAGAACCTGAGC 750
GTGATCGGCTTCCGCATCCTGCTGCTGAAGGTGGCCGGCTTCAACCTGCT 800
GATGACCCTGCGCCTGTGGAGCAGC [SEQ ID NO: 536]

Beta chain:

ATGGGCACCCGCCTGTTCTTCTACGTGGCCCTGTGCCTGCTGTGGGCCGG 50
CCACCGCGACGCCGGCATCACCCAGAGCCCCCGCTACAAGATCACCGAGA 100
CCGGCCGCCAGGTGACCCTGATGTGCCACCAGACCTGGAGCCACAGCTAC 150
ATGTTCTGGTACCGCCAGGACCTGGGCCACGGCCTGCGCCTGATCTACTA 200
CAGCGCCGCCGCCGACATCACCGACAAGGGCGAGGTGCCCGACGGCTACG 250
TGGTGAGCCGCAGCAAGACCGAGAACTTCCCCCTGACCCTGGAGAGCGCC 300
ACCCGCAGCCAGACCAGCGTGTACTTCTGCGCCAGCAGCTACGAGAACGA 350
GAAGCTGTTCTTCGGCAGCGGCACCCAGCTGAGCGTGCTGGAGGACCTGA 400
ACAAGGTGTTCCCCCCCGAGGTGGCCGTGTTCGAGCCCAGCGAGGCCGAG 450
ATCAGCCACACCCAGAAGGCCACCCTGGTGTGCCTGGCCACCGGCTTCTT 500
CCCCGACCACGTGGAGCTGAGCTGGTGGGTGAACGGCAAGGAGGTGCACA 550
GCGGCGTGTGCACCGACCCCCAGCCCCTGAAGGAGCAGCCCGCCCTGAAC 600
GACAGCCGCTACTGCCTGAGCAGCCGCCTGCGCGTGAGCGCCACCTTCTG 650
GCAGAACCCCCGCAACCACTTCCGCTGCCAGGTGCAGTTCTACGGCCTGA 700
GCGAGAACGACGAGTGGACCCAGGACCGCGCCAAGCCCGTGACCCAGATC 750
GTGAGCGCCGAGGCCTGGGGCCGCGCCGACTGCGGCTTCACCAGCGTGAG 800
CTACCAGCAGGGCGTGCTGAGCGCCACCATCCTGTACGAGATCCTGCTGG 850
GCAAGGCCACCCTGTACGCCGTGCTGGTGAGCGCCCTGGTGCTGATGGCC 900
ATGGTGAAGCGCAAGGACTTC [SEQ ID NO: 617]

FIG. 56

Donor Y6W Clone 5 (PYL)

Alpha chain:
ATGCTGCTGCTGCTGATCCCCGTGCTGGGCATGATCTTCGCCCTGCGCGA 50
CGCCCGCGCCCAGAGCGTGAGCCAGCACAACCACCACGTGATCCTGAGCG 100
AGGCCGCCAGCCTGGAGCTGGGCTGCAACTACAGCTACGGCGGCACCGTG 150
AACCTGTTCTGGTACGTGCAGTACCCCGGCCAGCACCTGCAGCTGCTGCT 200
GAAGTACTTCAGCGGCGACCCCCTGGTGAAGGGCATCAAGGGCTTCGAGG 250
CCGAGTTCATCAAGAGCAAGTTCAGCTTCAACCTGCGCAAGCCCAGCGTG 300
CAGTGGAGCGACACCGCCGAGTACTTCTGCGCCGTGAAGGCCAACTTCAA 350
CAAGTTCTACTTCGGCAGCGGCACCAAGCTGAACGTGAAGCCCAACATCC 400
AGAACCCCGACCCCGCCGTGTACCAGCTGCGCGACAGCAAGAGCAGCGAC 450
AAGAGCGTGTGCCTGTTCACCGACTTCGACAGCCAGACCAACGTGAGCCA 500
GAGCAAGGACAGCGACGTGTACATCACCGACAAGTGCGTGCTGGACATGC 550
GCAGCATGGACTTCAAGAGCAACAGCGCCGTGGCCTGGAGCAACAAGAGC 600
GACTTCGCCTGCGCCAACGCCTTCAACAACAGCATCATCCCCGAGGACAC 650
CTTCTTCCCCAGCCCCGAGAGCAGCTGCGACGTGAAGCTGGTGGAGAAGA 700
GCTTCGAGACCGACACCAACCTGAACTTCCAGAACCTGAGCGTGATCGGC 750
TTCCGCATCCTGCTGCTGAAGGTGGCCGGCTTCAACCTGCTGATGACCCT 800
GCGCCTGTGGAGCAGC [SEQ ID NO: 537]

Beta chain:
ATGGACACCTGGCTGGTGTGCTGGGCCATCTTCAGCCTGCTGAAGGCCGG 50
CCTGACCGAGCCCGAGGTGACCCAGACCCCCAGCCACCAGGTGACCCAGA 100
TGGGCCAGGAGGTGATCCTGCGCTGCGTGCCCATCAGCAACCACCTGTAC 150
TTCTACTGGTACCGCCAGATCCTGGGCCAGAAGGTGGAGTTCCTGGTGAG 200
CTTCTACAACAACGAGATCAGCGAGAAGAGCGAGATCTTCGACGACCAGT 250
TCAGCGTGGAGCGCCCCGACGGCAGCAACTTCACCCTGAAGATCCGCAGC 300
ACCAAGCTGGAGGACAGCGCCATGTACTTCTGCGCCAGCAGCTGGGGCAA 350
CGAGCAGTTCTTCGGCCCCGGCACCCGCCTGACCGTGCTGGAGGACCTGA 400
ACAAGGTGTTCCCCCCCGAGGTGGCCGTGTTCGAGCCCAGCGAGGCCGAG 450
ATCAGCCACACCCAGAAGGCCACCCTGGTGTGCCTGGCCACCGGCTTCTT 500
CCCCGACCACGTGGAGCTGAGCTGGTGGGTGAACGGCAAGGAGGTGCACA 550
GCGGCGTGTGCACCGACCCCCAGCCCCTGAAGGAGCAGCCCGCCCTGAAC 600
GACAGCCGCTACTGCCTGAGCAGCCGCCTGCGCGTGAGCGCCACCTTCTG 650
GCAGAACCCCCGCAACCACTTCCGCTGCCAGGTGCAGTTCTACGGCCTGA 700
GCGAGAACGACGAGTGGACCCAGGACCGCGCCAAGCCCGTGACCCAGATC 750
GTGAGCGCCGAGGCCTGGGGCCGCGCCGACTGCGGCTTCACCAGCGTGAG 800
CTACCAGCAGGGCGTGCTGAGCGCCACCATCCTGTACGAGATCCTGCTGG 850
GCAAGGCCACCCTGTACGCCGTGCTGGTGAGCGCCCTGGTGCTGATGGCC 900
ATGGTGAAGCGCAAGGACTTC [SEQ ID NO: 618]

FIG. 57

Donor Y6W Clone 6 (PYL)

Alpha chain:

ATGAAGAGCCTGCGCGTGCTGCTGGTGATCCTGTGGCTGCAGCTGAGCTG 50
GGTGTGGAGCCAGCAGAAGGAGGTGGAGCAGAACAGCGGCCCCCTGAGCG 100
TGCCCGAGGGCGCCATCGCCAGCCTGAACTGCACCTACAGCGACCGCGGC 150
AGCCAGAGCTTCTTCTGGTACCGCCAGTACAGCGGCAAGAGCCCCGAGCT 200
GATCATGTTCATCTACAGCAACGGCGACAAGGAGGACGGCCGCTTCACCG 250
CCCAGCTGAACAAGGCCAGCCAGTACGTGAGCCTGCTGATCCGCGACAGC 300
CAGCCCAGCGACAGCGCCACCTACCTGTGCGCCGCCGAGCCCTTCAGCAG 350
CTACAAGCTGATCTTCGGCAGCGGCACCCGCCTGCTGGTGCGCCCCGACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 538]

Beta chain:

ATGGGCACCCGCCTGCTGTTCTGGGTGGCCTTCTGCCTGCTGGGCGCCGA 50
CCACACCGGCGCCGGCGTGAGCCAGAGCCCCAGCAACAAGGTGACCGAGA 100
AGGGCAAGGACGTGGAGCTGCGCTGCGACCCCATCAGCGGCCACACCGCC 150
CTGTACTGGTACCGCCAGAGCCTGGGCCAGGGCCTGGAGTTCCTGATCTA 200
CTTCCAGGGCAACAGCGCCCCCGACAAGAGCGGCCTGCCCAGCGACCGCT 250
TCAGCGCCGAGCGCACCGGCGGCAGCGTGAGCACCCTGACCATCCAGCGC 300
ACCCAGCAGGAGGACAGCGCCGTGTACCTGTGCGCCAGCAGCTTCATCGG 350
CGGCACCGGCCTGAACGAGCAGTTCTTCGGCCCCGGCACCCGCCTGACCG 400
TGCTGGAGGACCTGAACAAGGTGTTCCCCCCCGAGGTGGCCGTGTTCGAG 450
CCCAGCGAGGCCGAGATCAGCCACACCCAGAAGGCCACCCTGGTGTGCCT 500
GGCCACCGGCTTCTTCCCCGACCACGTGGAGCTGAGCTGGTGGGTGAACG 550
GCAAGGAGGTGCACAGCGGCGTGTGCACCGACCCCCAGCCCCTGAAGGAG 600
CAGCCCGCCCTGAACGACAGCCGCTACTGCCTGAGCAGCCGCCTGCGCGT 650
GAGCGCCACCTTCTGGCAGAACCCCCGCAACCACTTCCGCTGCCAGGTGC 700
AGTTCTACGGCCTGAGCGAGAACGACGAGTGGACCCAGGACCGCGCCAAG 750
CCCGTGACCCAGATCGTGAGCGCCGAGGCCTGGGGCCGCGCCGACTGCGG 800
CTTCACCAGCGTGAGCTACCAGCAGGGCGTGCTGAGCGCCACCATCCTGT 850
ACGAGATCCTGCTGGGCAAGGCCACCCTGTACGCCGTGCTGGTGAGCGCC 900
CTGGTGCTGATGGCCATGGTGAAGCGCAAGGACTTC [SEQ ID NO :619]

FIG. 58

Donor Y6W Clone 7 (PYL)

Alpha chain:

ATGATGAAGTGCCCCCAGGCCCTGCTGGCCATCTTCTGGCTGCTGCTGAG 50
CTGGGTGAGCAGCGAGGACAAGGTGGTGCAGAGCCCCCTGAGCCTGGTGG 100
TGCACGAGGGCGACACCGTGACCCTGAACTGCAGCTACGAGGTGACCAAC 150
TTCCGCAGCCTGCTGTGGTACAAGCAGGAGAAGAAGGCCCCCACCTTCCT 200
GTTCATGCTGACCAGCAGCGGCATCGAGAAGAAGAGCGGCCGCCTGAGCA 250
GCATCCTGGACAAGAAGGAGCTGAGCAGCATCCTGAACATCACCGCCACC 300
CAGACCGGCGACAGCGCCATCTACCTGTGCGCCGTGGAGAGCCTGATCCA 350
GGGCGCCCAGAAGCTGGTGTTCGGCCAGGGCACCCGCCTGACCATCAACC 400
CCAACATCCAGAACCCCGACCCCGCCGTGTACCAGCTGCGCGACAGCAAG 450
AGCAGCGACAAGAGCGTGTGCCTGTTCACCGACTTCGACAGCCAGACCAA 500
CGTGAGCCAGAGCAAGGACAGCGACGTGTACATCACCGACAAGTGCGTGC 550
TGGACATGCGCAGCATGGACTTCAAGAGCAACAGCGCCGTGGCCTGGAGC 600
AACAAGAGCGACTTCGCCTGCGCCAACGCCTTCAACAACAGCATCATCCC 650
CGAGGACACCTTCTTCCCCAGCCCCGAGAGCAGCTGCGACGTGAAGCTGG 700
TGGAGAAGAGCTTCGAGACCGACACCAACCTGAACTTCCAGAACCTGAGC 750
GTGATCGGCTTCCGCATCCTGCTGCTGAAGGTGGCCGGCTTCAACCTGCT 800
GATGACCCTGCGCCTGTGGAGCAGC [SEQ ID NO: 539]

Beta chain:

ATGCTGCTGCTGCTGCTGCTGCTGCTGGGCCCCGGCATCAGCCTGCTGCTGCC 50
CGGCAGCCTGGCCGGCAGCGGCCTGGGCGCCGTGGTGAGCCAGCACCCCA 100
GCTGGGTGATCTGCAAGAGCGGCACCAGCGTGAAGATCGAGTGCCGCAGC 150
CTGGACTTCCAGGCCACCACCATGTTCTGGTACCGCCAGTTCCCCAAGCA 200
GAGCCTGATGCTGATGGCCACCAGCAACGAGGGCAGCAAGGCCACCTACG 250
AGCAGGGCGTGGAGAAGGACAAGTTCCTGATCAACCACGCCAGCCTGACC 300
CTGAGCACCCTGACCGTGACCAGCGCCCACCCCGAGGACAGCAGCTTCTA 350
CATCTGCAGCGCCCGCGACCGCTTCTGGGGCACCAACAACGAGAAGCTGT 400
TCTTCGGCAGCGGCACCCAGCTGAGCGTGCTGGAGGACCTGAACAAGGTG 450
TTCCCCCCCGAGGTGGCCGTGTTCGAGCCCAGCGAGGCCGAGATCAGCCA 500
CACCCAGAAGGCCACCCTGGTGTGCCTGGCCACCGGCTTCTTCCCCGACC 550
ACGTGGAGCTGAGCTGGTGGGTGAACGGCAAGGAGGTGCACAGCGGCGTG 600
TGCACCGACCCCCAGCCCCTGAAGGAGCAGCCCGCCCTGAACGACAGCCG 650
CTACTGCCTGAGCAGCCGCCTGCGCGTGAGCGCCACCTTCTGGCAGAACC 700
CCCGCAACCACTTCCGCTGCCAGGTGCAGTTCTACGGCCTGAGCGAGAAC 750
GACGAGTGGACCCAGGACCGCGCCAAGCCCGTGACCCAGATCGTGAGCGC 800
CGAGGCCTGGGGCCGCGCCGACTGCGGCTTCACCAGCGTGAGCTACCAGC 850
AGGGCGTGCTGAGCGCCACCATCCTGTACGAGATCCTGCTGGGCAAGGCC 900
ACCCTGTACGCCGTGCTGGTGAGCGCCCTGGTGCTGATGGCCATGGTGAA 950
GCGCAAGGACTTC [SEQ ID NO: 620]

FIG. 59

Donor Y6W Clone 8 (PYL)

Alpha chain:

```
ATGCGCCTGGTGGCCCGCGTGACCGTGTTCCTGACCTTCGGCACCATCAT    50
CGACGCCAAGACCACCCAGCCCCCCAGCATGGACTGCGCCGAGGGCCGCG    100
CCGCCAACCTGCCCTGCAACCACAGCACCATCAGCGGCAACGAGTACGTG    150
TACTGGTACCGCCAGATCCACAGCCAGGGCCCCCAGTACATCATCCACGG    200
CCTGAAGAACAACGAGACCAACGAGATGGCCAGCCTGATCATCACCGAGG    250
ACCGCAAGAGCAGCACCCTGATCCTGCCCCACGCCACCCTGCGCGACACC    300
GCCGTGTACTACTGCATCGTGCGCGTGGCCGGCGGCACCAGCTACGGCAA    350
GCTGACCTTCGGCCAGGGCACCATCCTGACCGTGCACCCCAACATCCAGA    400
ACCCCGACCCCGCCGTGTACCAGCTGCGCGACAGCAAGAGCAGCGACAAG    450
AGCGTGTGCCTGTTCACCGACTTCGACAGCCAGACCAACGTGAGCCAGAG    500
CAAGGACAGCGACGTGTACATCACCGACAAGTGCGTGCTGGACATGCGCA    550
GCATGGACTTCAAGAGCAACAGCGCCGTGGCCTGGAGCAACAAGAGCGAC    600
TTCGCCTGCGCCAACGCCTTCAACAACAGCATCATCCCCGAGGACACCTT    650
CTTCCCCAGCCCCGAGAGCAGCTGCGACGTGAAGCTGGTGGAGAAGAGCT    700
TCGAGACCGACACCAACCTGAACTTCCAGAACCTGAGCGTGATCGGCTTC    750
CGCATCCTGCTGCTGAAGGTGGCCGGCTTCAACCTGCTGATGACCCTGCG    800
CCTGTGGAGCAGC [SEQ ID NO: 540]
```

Beta chain:

```
ATGCTGTGCAGCCTGCTGGCCCTGCTGCTGGGCACCTTCTTCGGCGTGCG    50
CAGCCAGACCATCCACCAGTGGCCCGCCACCCTGGTGCAGCCCGTGGGCA    100
GCCCCCTGAGCCTGGAGTGCACCGTGGAGGGCACCAGCAACCCCAACCTG    150
TACTGGTACCGCCAGGCCGCCGGCCGCGGCCTGCAGCTGCTGTTCTACAG    200
CGTGGGCATCGGCCAGATCAGCAGCGAGGTGCCCCAGAACCTGAGCGCCA    250
GCCGCCCCCAGGACCGCCAGTTCATCCTGAGCAGCAAGAAGCTGCTGCTG    300
AGCGACAGCGGCTTCTACCTGTGCGCCTGGAGCAGCGCCCCCGACCGCGG    350
CCACCGCCAGCCCCAGCACTTCGGCGACGGCACCCGCCTGAGCATCCTGG    400
AGGACCTGAACAAGGTGTTCCCCCCCGAGGTGGCCGTGTTCGAGCCCAGC    450
GAGGCCGAGATCAGCCACACCCAGAAGGCCACCCTGGTGTGCCTGGCCAC    500
CGGCTTCTTCCCCGACCACGTGGAGCTGAGCTGGTGGGTGAACGGCAAGG    550
AGGTGCACAGCGGCGTGTGCACCGACCCCCAGCCCCTGAAGGAGCAGCCC    600
GCCCTGAACGACAGCCGCTACTGCCTGAGCAGCCGCCTGCGCGTGAGCGC    650
CACCTTCTGGCAGAACCCCCGCAACCACTTCCGCTGCCAGGTGCAGTTCT    700
ACGGCCTGAGCGAGAACGACGAGTGGACCCAGGACCGCGCCAAGCCCGTG    750
ACCCAGATCGTGAGCGCCGAGGCCTGGGGCCGCGCCGACTGCGGCTTCAC    800
CAGCGTGAGCTACCAGCAGGGCGTGCTGAGCGCCACCATCCTGTACGAGA    850
TCCTGCTGGGCAAGGCCACCCTGTACGCCGTGCTGGTGAGCGCCCTGGTG    900
CTGATGGCCATGGTGAAGCGCAAGGACTTC [SEQ ID NO: 621]
```

FIG. 60

Donor Y6W Clone 9 (PYL)

Alpha chain:

ATGAGCCTGAGCAGCCTGCTGAAGGTGGTGACCGCCAGCCTGTGGCTGGG 50
CCCCGGCATCGCCCAGAAGATCACCCAGACCCAGCCCGGCATGTTCGTGC 100
AGGAGAAGGAGGCCGTGACCCTGGACTGCACCTACGACACCAGCGACCAG 150
AGCTACGGCCTGTTCTGGTACAAGCAGCCCAGCAGCGGCGAGATGATCTT 200
CCTGATCTACCAGGGCAGCTACGACGAGCAGAACGCCACCGAGGGCCGCT 250
ACAGCCTGAACTTCCAGAAGGCCCGCAAGAGCGCCAACCTGGTGATCAGC 300
GCCAGCCAGCTGGGCGACAGCGCCATGTACTTCTGCGCCATGCGCGTGAA 350
CAGCGGCGGCTACCAGAAGGTGACCTTCGGCACCGGCACCAAGCTGCAGG 400
TGATCCCCAACATCCAGAACCCCGACCCCGCCGTGTACCAGCTGCGCGAC 450
AGCAAGAGCAGCGACAAGAGCGTGTGCCTGTTCACCGACTTCGACAGCCA 500
GACCAACGTGAGCCAGAGCAAGGACAGCGACGTGTACATCACCGACAAGT 550
GCGTGCTGGACATGCGCAGCATGGACTTCAAGAGCAACAGCGCCGTGGCC 600
TGGAGCAACAAGAGCGACTTCGCCTGCGCCAACGCCTTCAACAACAGCAT 650
CATCCCCGAGGACACCTTCTTCCCCAGCCCCGAGAGCAGCTGCGACGTGA 700
AGCTGGTGGAGAAGAGCTTCGAGACCGACACCAACCTGAACTTCCAGAAC 750
CTGAGCGTGATCGGCTTCCGCATCCTGCTGCTGAAGGTGGCCGGCTTCAA 800
CCTGCTGATGACCCTGCGCCTGTGGAGCAGC [SEQ ID NO: 541]

Beta chain:

ATGGGCCCCGGCCTGCTGCACTGGATGGCCCTGTGCCTGCTGGGCACCGG 50
CCACGGCGACGCCATGGTGATCCAGAACCCCCGCTACCAGGTGACCCAGT 100
TCGGCAAGCCCGTGACCCTGAGCTGCAGCCAGACCCTGAACCACAACGTG 150
ATGTACTGGTACCAGCAGAAGAGCAGCCAGGCCCCCAAGCTGCTGTTCCA 200
CTACTACGACAAGGACTTCAACAACGAGGCCGACACCCCCGACAACTTCC 250
AGAGCCGCCGCCCCAACACCAGCTTCTGCTTCCTGGACATCCGCAGCCCC 300
GGCCTGGGCGACACCGCCATGTACCTGTGCGCCACCAGCCGCGACCGCGG 350
CACCGGCCCCCCCTACGAGCAGTACTTCGGCCCCGGCACCCGCCTGACCG 400
TGACCGAGGACCTGAACAAGGTGTTCCCCCCCGAGGTGGCCGTGTTCGAG 450
CCCAGCGAGGCCGAGATCAGCCACACCCAGAAGGCCACCCTGGTGTGCCT 500
GGCCACCGGCTTCTTCCCCGACCACGTGGAGCTGAGCTGGTGGGTGAACG 550
GCAAGGAGGTGCACAGCGGCGTGTGCACCGACCCCCAGCCCCTGAAGGAG 600
CAGCCCGCCCTGAACGACAGCCGCTACTGCCTGAGCAGCCGCCTGCGCGT 650
GAGCGCCACCTTCTGGCAGAACCCCCGCAACCACTTCCGCTGCCAGGTGC 700
AGTTCTACGGCCTGAGCGAGAACGACGAGTGGACCCAGGACCGCGCCAAG 750
CCCGTGACCCAGATCGTGAGCGCCGAGGCCTGGGGCCGCGCCGACTGCGG 800
CTTCACCAGCGTGAGCTACCAGCAGGGCGTGCTGAGCGCCACCATCCTGT 850
ACGAGATCCTGCTGGGCAAGGCCACCCTGTACGCCGTGCTGGTGAGCGCC 900
CTGGTGCTGATGGCCATGGTGAAGCGCAAGGACTTC [SEQ ID NO: 622]

FIG. 61

Donor Y6W Clone 10 (PYL)

Alpha chain:

ATGATCAGCCTGCGCGTGCTGCTGGTGATCCTGTGGCTGCAGCTGAGCTG 50
GGTGTGGAGCCAGCGCAAGGAGGTGGAGCAGGACCCCGGCCCCTTCAACG 100
TGCCCGAGGGCGCCACCGTGGCCTTCAACTGCACCTACAGCAACAGCGCC 150
AGCCAGAGCTTCTTCTGGTACCGCCAGGACTGCCGCAAGGAGCCCAAGCT 200
GCTGATGAGCGTGTACAGCAGCGGCAACGAGGACGGCCGCTTCACCGCCC 250
AGCTGAACCGCGCCAGCCAGTACATCAGCCTGCTGATCCGCGACAGCAAG 300
CTGAGCGACAGCGCCACCTACCTGTGCGTGCTGAGCGGCGCCGGCAGCTA 350
CCAGCTGACCTTCGGCAAGGGCACCAAGCTGAGCGTGATCCCCAACATCC 400
AGAACCCCGACCCCGCCGTGTACCAGCTGCGCGACAGCAAGAGCAGCGAC 450
AAGAGCGTGTGCCTGTTCACCGACTTCGACAGCCAGACCAACGTGAGCCA 500
GAGCAAGGACAGCGACGTGTACATCACCGACAAGTGCGTGCTGGACATGC 550
GCAGCATGGACTTCAAGAGCAACAGCGCCGTGGCCTGGAGCAACAAGAGC 600
GACTTCGCCTGCGCCAACGCCTTCAACAACAGCATCATCCCCGAGGACAC 650
CTTCTTCCCCAGCCCCGAGAGCAGCTGCGACGTGAAGCTGGTGGAGAAGA 700
GCTTCGAGACCGACACCAACCTGAACTTCCAGAACCTGAGCGTGATCGGC 750
TTCCGCATCCTGCTGCTGAAGGTGGCCGGCTTCAACCTGCTGATGACCCT 800
GCGCCTGTGGAGCAGC [SEQ ID NO: 542]

Beta chain:

ATGAGCATCGGCCTGCTGTGCTGCGTGGCCTTCAGCCTGCTGTGGGCCAG 50
CCCCGTGAACGCCGGCGTGACCCAGACCCCCAAGTTCCAGGTGCTGAAGA 100
CCGGCCAGAGCATGACCCTGCAGTGCGCCCAGGACATGAACCACAACAGC 150
ATGTACTGGTACCGCCAGGACCCCGGCATGGGCCTGCGCCTGATCTACTA 200
CAGCGCCAGCGAGGGCACCACCGACAAGGGCGAGGTGCCCAACGGCTACA 250
ACGTGAGCCGCCTGAACAAGCGCGAGTTCAGCCTGCGCCTGGAGAGCGCC 300
GCCCCCAGCCAGACCAGCGTGTACTTCTGCGCCAGCAGCGAGTGGCGCGA 350
GGAGACCCAGTACTTCGGCCCCGGCACCCGCCTGCTGGTGCTGGAGGACC 400
TGAACAAGGTGTTCCCCCCCGAGGTGGCCGTGTTCGAGCCCAGCGAGGCC 450
GAGATCAGCCACACCCAGAAGGCCACCCTGGTGTGCCTGGCCACCGGCTT 500
CTTCCCCGACCACGTGGAGCTGAGCTGGTGGGTGAACGGCAAGGAGGTGC 550
ACAGCGGCGTGTGCACCGACCCCCAGCCCCTGAAGGAGCAGCCCGCCCTG 600
AACGACAGCCGCTACTGCCTGAGCAGCCGCCTGCGCGTGAGCGCCACCTT 650
CTGGCAGAACCCCCGCAACCACTTCCGCTGCCAGGTGCAGTTCTACGGCC 700
TGAGCGAGAACGACGAGTGGACCCAGGACCGCGCCAAGCCCGTGACCCAG 750
ATCGTGAGCGCCGAGGCCTGGGGCCGCGCCGACTGCGGCTTCACCAGCGT 800
GAGCTACCAGCAGGGCGTGCTGAGCGCCACCATCCTGTACGAGATCCTGC 850
TGGGCAAGGCCACCCTGTACGCCGTGCTGGTGAGCGCCCTGGTGCTGATG 900
GCCATGGTGAAGCGCAAGGACTTC [SEQ ID NO: 623]

FIG. 62

Donor Y6W Clone 11 (PYL)

Alpha chain:

ATGGAGAGCTTCCTGGGCGGCGTGCTGCTGATCCTGTGGCTGCAGGTGGA 50
CTGGGTGAAGAGCCAGAAGATCGAGCAGAACAGCGAGGCCCTGAACATCC 100
AGGAGGGCAAGACCGCCACCCTGACCTGCAACTACACCAACTACAGCCCC 150
GCCTACCTGCAGTGGTACCGCCAGGACCCCGGCCGCGGCCCCGTGTTCCT 200
GCTGCTGATCCGCGAGAACGAGAAGGAGAAGCGCAAGGAGCGCCTGAAGG 250
TGACCTTCGACACCACCCTGAAGCAGAGCCTGTTCCACATCACCGCCAGC 300
CAGCCCGCCGACAGCGCCACCTACCTGTGCGCCCTGGACGAGGGCAACAC 350
CGGCTTCCAGAAGCTGGTGTTCGGCACCGGCACCCGCCTGCTGGTGAGCC 400
CCAACATCCAGAACCCCGACCCCGCCGTGTACCAGCTGCGCGACAGCAAG 450
AGCAGCGACAAGAGCGTGTGCCTGTTCACCGACTTCGACAGCCAGACCAA 500
CGTGAGCCAGAGCAAGGACAGCGACGTGTACATCACCGACAAGTGCGTGC 550
TGGACATGCGCAGCATGGACTTCAAGAGCAACAGCGCCGTGGCCTGGAGC 600
AACAAGAGCGACTTCGCCTGCGCCAACGCCTTCAACAACAGCATCATCCC 650
CGAGGACACCTTCTTCCCCAGCCCCGAGAGCAGCTGCGACGTGAAGCTGG 700
TGGAGAAGAGCTTCGAGACCGACACCAACCTGAACTTCCAGAACCTGAGC 750
GTGATCGGCTTCCGCATCCTGCTGCTGAAGGTGGCCGGCTTCAACCTGCT 800
GATGACCCTGCGCCTGTGGAGCAGC [SEQ ID NO: 543]

Beta chain:

ATGCTGTGCAGCCTGCTGGCCCTGCTGCTGGGCACCTTCTTCGGCGTGCG 50
CAGCCAGACCATCCACCAGTGGCCCGCCACCCTGGTGCAGCCCGTGGGCA 100
GCCCCCTGAGCCTGGAGTGCACCGTGGAGGGCACCAGCAACCCCAACCTG 150
TACTGGTACCGCCAGGCCGCCGGCCGCGGCCTGCAGCTGCTGTTCTACAG 200
CGTGGGCATCGGCCAGATCAGCAGCGAGGTGCCCCAGAACCTGAGCGCCA 250
GCCGCCCCCAGGACCGCCAGTTCATCCTGAGCAGCAAGAAGCTGCTGCTG 300
AGCGACAGCGGCTTCTACCTGTGCGCCTGGAGCGGCACCGACAGCAGCTA 350
CGAGCAGTACTTCGGCCCCGGCACCCGCCTGACCGTGACCGAGGACCTGA 400
ACAAGGTGTTCCCCCCCGAGGTGGCCGTGTTCGAGCCCAGCGAGGCCGAG 450
ATCAGCCACACCCAGAAGGCCACCCTGGTGTGCCTGGCCACCGGCTTCTT 500
CCCCGACCACGTGGAGCTGAGCTGGTGGGTGAACGGCAAGGAGGTGCACA 550
GCGGCGTGTGCACCGACCCCCAGCCCCTGAAGGAGCAGCCCGCCCTGAAC 600
GACAGCCGCTACTGCCTGAGCAGCCGCCTGCGCGTGAGCGCCACCTTCTG 650
GCAGAACCCCCGCAACCACTTCCGCTGCCAGGTGCAGTTCTACGGCCTGA 700
GCGAGAACGACGAGTGGACCCAGGACCGCGCCAAGCCCGTGACCCAGATC 750
GTGAGCGCCGAGGCCTGGGGCCGCGCCGACTGCGGCTTCACCAGCGTGAG 800
CTACCAGCAGGGCGTGCTGAGCGCCACCATCCTGTACGAGATCCTGCTGG 850
GCAAGGCCACCCTGTACGCCGTGCTGGTGAGCGCCCTGGTGCTGATGGCC 900
ATGGTGAAGCGCAAGGACTTC [SEQ ID NO: 624]

FIG. 63

Donor Y6W Clone 12 (PYL)

Alpha chain:

```
ATGTGGGGCGTGTTCCTGCTGTACGTGAGCATGAAGATGGGCGGCACCAC      50
CGGCCAGAACATCGACCAGCCCACCGAGATGACCGCCACCGAGGGCGCCA      100
TCGTGCAGATCAACTGCACCTACCAGACCAGCGGCTTCAACGGCCTGTTC      150
TGGTACCAGCAGCACGCCGGCGAGGCCCCCACCTTCCTGAGCTACAACGT      200
GCTGGACGGCCTGGAGGAGAAGGGCCGCTTCAGCAGCTTCCTGAGCCGCA      250
GCAAGGGCTACAGCTACCTGCTGCTGAAGGAGCTGCAGATGAAGGACAGC      300
GCCAGCCGCAACACCGGCTTCCAGAAGCTGGTGTTCGGCACCGGCACCCG      350
CCTGCTGGTGAGCCCCAACATCCAGAACCCCGACCCCGCCGTGTACCAGC      400
TGCGCGACAGCAAGAGCAGCGACAAGAGCGTGTGCCTGTTCACCGACTTC      450
GACAGCCAGACCAACGTGAGCCAGAGCAAGGACAGCGACGTGTACATCAC      500
CGACAAGTGCGTGCTGGACATGCGCAGCATGGACTTCAAGAGCAACAGCG      550
CCGTGGCCTGGAGCAACAAGAGCGACTTCGCCTGCGCCAACGCCTTCAAC      600
AACAGCATCATCCCCGAGGACACCTTCTTCCCCAGCCCCGAGAGCAGCTG      650
CGACGTGAAGCTGGTGGAGAAGAGCTTCGAGACCGACACCAACCTGAACT      700
TCCAGAACCTGAGCGTGATCGGCTTCCGCATCCTGCTGCTGAAGGTGGCC      750
GGCTTCAACCTGCTGATGACCCTGCGCCTGTGGAGCAGC [SEQ ID NO: 544]
```

Beta chain:

```
ATGGGCATCCGCCTGCTGTGCCGCGTGGCCTTCTGCTTCCTGGCCGTGGG      50
CCTGGTGGACGTGAAGGTGACCCAGAGCAGCCGCTACCTGGTGAAGCGCA      100
CCGGCGAGAAGGTGTTCCTGGAGTGCGTGCAGGACATGGACCACGAGAAC      150
ATGTTCTGGTACCGCCAGGACCCCGGCCTGGGCCTGCGCCTGATCTACTT      200
CAGCTACGACGTGAAGATGAAGGAGAAGGGCGACATCCCCGAGGGCTACA      250
GCGTGAGCCGCGAGAAGAAGGAGCGCTTCAGCCTGATCCTGGAGAGCGCC      300
AGCACCAACCAGACCAGCATGTACCTGTGCGCCAGCAGCCCCGAGCAGGG      350
CGCCGCCGGCGACGAGCAGTTCTTCGGCCCCGGCACCCGCCTGACCGTGC      400
TGGAGGACCTGAACAAGGTGTTCCCCCCCGAGGTGGCCGTGTTCGAGCCC      450
AGCGAGGCCGAGATCAGCCACACCCAGAAGGCCACCCTGGTGTGCCTGGC      500
CACCGGCTTCTTCCCCGACCACGTGGAGCTGAGCTGGTGGGTGAACGGCA      550
AGGAGGTGCACAGCGGCGTGTGCACCGACCCCCAGCCCCTGAAGGAGCAG      600
CCCGCCCTGAACGACAGCCGCTACTGCCTGAGCAGCCGCCTGCGCGTGAG      650
CGCCACCTTCTGGCAGAACCCCCGCAACCACTTCCGCTGCCAGGTGCAGT      700
TCTACGGCCTGAGCGAGAACGACGAGTGGACCCAGGACCGCGCCAAGCCC      750
GTGACCCAGATCGTGAGCGCCGAGGCCTGGGGCCGCGCCGACTGCGGCTT      800
CACCAGCGTGAGCTACCAGCAGGGCGTGCTGAGCGCCACCATCCTGTACG      850
AGATCCTGCTGGGCAAGGCCACCCTGTACGCCGTGCTGGTGAGCGCCCTG      900
GTGCTGATGGCCATGGTGAAGCGCAAGGACTTC [SEQ ID NO: 625]
```

FIG. 64

Donor Y6W Clone 13 (PYL)

Alpha chain:

ATGCTGCTGGAGCTGATCCCCCTGCTGGGCATCCACTTCGTGCTGCGCAC 50
CGCCCGCGCCCAGAGCGTGACCCAGCCCGACATCCACATCACCGTGAGCG 100
AGGGCGCCAGCCTGGAGCTGCGCTGCAACTACAGCTACGGCGCCACCCCC 150
TACCTGTTCTGGTACGTGCAGAGCCCCGGCCAGGGCCTGCAGCTGCTGCT 200
GAAGTACTTCAGCGGCGACACCCTGGTGCAGGGCATCAAGGGCTTCGAGG 250
CCGAGTTCAAGCGCAGCCAGAGCAGCTTCAACCTGCGCAAGCCCAGCGTG 300
CACTGGAGCGACGCCGCCGAGTACTTCTGCGCCGCCCCCGGCGTGGGCAG 350
CAACAGCGGCTACGCCCTGAACTTCGGCAAGGGCACCAGCCTGCTGGTGA 400
CCCCCCACATCCAGAACCCCGACCCCGCCGTGTACCAGCTGCGCGACAGC 450
AAGAGCAGCGACAAGAGCGTGTGCCTGTTCACCGACTTCGACAGCCAGAC 500
CAACGTGAGCCAGAGCAAGGACAGCGACGTGTACATCACCGACAAGTGCG 550
TGCTGGACATGCGCAGCATGGACTTCAAGAGCAACAGCGCCGTGGCCTGG 600
AGCAACAAGAGCGACTTCGCCTGCGCCAACGCCTTCAACAACAGCATCAT 650
CCCCGAGGACACCTTCTTCCCCAGCCCCGAGAGCAGCTGCGACGTGAAGC 700
TGGTGGAGAAGAGCTTCGAGACCGACACCAACCTGAACTTCCAGAACCTG 750
AGCGTGATCGGCTTCCGCATCCTGCTGCTGAAGGTGGCCGGCTTCAACCT 800
GCTGATGACCCTGCGCCTGTGGAGCAGC [SEQ ID NO: 545]

Beta chain:

ATGGGCTTCCGCCTGCTGTGCTGCGTGGCCTTCTGCCTGCTGGGCGCCGG 50
CCCCGTGGACAGCGGCGTGACCCAGACCCCCAAGCACCTGATCACCGCCA 100
CCGGCCAGCGCGTGACCCTGCGCTGCAGCCCCCGCAGCGGCGACCTGAGC 150
GTGTACTGGTACCAGCAGAGCCTGGACCAGGGCCTGCAGTTCCTGATCCA 200
GTACTACAACGGCGAGGAGCGCGCCAAGGGCAACATCCTGGAGCGCTTCA 250
GCGCCCAGCAGTTCCCCGACCTGCACAGCGAGCTGAACCTGAGCAGCCTG 300
GAGCTGGGCGACAGCGCCCTGTACTTCTGCGCCAGCAGCCCCAGCTGGGC 350
CGCCAACAGCCCCCTGCACTTCGGCAACGGCACCCGCCTGACCGTGACCG 400
AGGACCTGAACAAGGTGTTCCCCCCCGAGGTGGCCGTGTTCGAGCCCAGC 450
GAGGCCGAGATCAGCCACACCCAGAAGGCCACCCTGGTGTGCCTGGCCAC 500
CGGCTTCTTCCCCGACCACGTGGAGCTGAGCTGGTGGGTGAACGGCAAGG 550
AGGTGCACAGCGGCGTGTGCACCGACCCCCAGCCCCTGAAGGAGCAGCCC 600
GCCCTGAACGACAGCCGCTACTGCCTGAGCAGCCGCCTGCGCGTGAGCGC 650
CACCTTCTGGCAGAACCCCCGCAACCACTTCCGCTGCCAGGTGCAGTTCT 700
ACGGCCTGAGCGAGAACGACGAGTGGACCCAGGACCGCGCCAAGCCCGTG 750
ACCCAGATCGTGAGCGCCGAGGCCTGGGGCCGCGCCGACTGCGGCTTCAC 800
CAGCGTGAGCTACCAGCAGGGCGTGCTGAGCGCCACCATCCTGTACGAGA 850
TCCTGCTGGGCAAGGCCACCCTGTACGCCGTGCTGGTGAGCGCCCTGGTG 900
CTGATGGCCATGGTGAAGCGCAAGGACTTC [SEQ ID NO: 626]

FIG. 65

Donor Y6W Clone 14 (PYL)

Alpha chain:
ATGTGGGGCGTGTTCCTGCTGTACGTGAGCATGAAGATGGGCGGCACCAC 50
CGGCCAGAACATCGACCAGCCCACCGAGATGACCGCCACCGAGGGCGCCA 100
TCGTGCAGATCAACTGCACCTACCAGACCAGCGGCTTCAACGGCCTGTTC 150
TGGTACCAGCAGCACGCCGGCGAGGCCCCCACCTTCCTGAGCTACAACGT 200
GCTGGACGGCCTGGAGGAGAAGGGCCGCTTCAGCAGCTTCCTGAGCCGCA 250
GCAAGGGCTACAGCTACCTGCTGCTGAAGGAGCTGCAGATGAAGGACAGC 300
GCCAGCTACCTGTGCGCCGGCGAGGACCAGACCGGCGCCAACAACCTGTT 350
CTTCGGCACCGGCACCCGCCTGACCGTGATCCCCTACATCCAGAACCCCG 400
ACCCCGCCGTGTACCAGCTGCGCGACAGCAAGAGCAGCGACAAGAGCGTG 450
TGCCTGTTCACCGACTTCGACAGCCAGACCAACGTGAGCCAGAGCAAGGA 500
CAGCGACGTGTACATCACCGACAAGTGCGTGCTGGACATGCGCAGCATGG 550
ACTTCAAGAGCAACAGCGCCGTGGCCTGGAGCAACAAGAGCGACTTCGCC 600
TGCGCCAACGCCTTCAACAACAGCATCATCCCCGAGGACACCTTCTTCCC 650
CAGCCCCGAGAGCAGCTGCGACGTGAAGCTGGTGGAGAAGAGCTTCGAGA 700
CCGACACCAACCTGAACTTCCAGAACCTGAGCGTGATCGGCTTCCGCATC 750
CTGCTGCTGAAGGTGGCCGGCTTCAACCTGCTGATGACCCTGCGCCTGTG 800
GAGCAGC [SEQ ID NO: 546]

Beta chain:
ATGGGCATCCGCCTGCTGTGCCGCGTGGCCTTCTGCTTCCTGGCCGTGGG 50
CCTGGTGGACGTGAAGGTGACCCAGAGCAGCCGCTACCTGGTGAAGCGCA 100
CCGGCGAGAAGGTGTTCCTGGAGTGCGTGCAGGACATGGACCACGAGAAC 150
ATGTTCTGGTACCGCCAGGACCCCGGCCTGGGCCTGCGCCTGATCTACTT 200
CAGCTACGACGTGAAGATGAAGGAGAAGGGCGACATCCCCGAGGGCTACA 250
GCGTGAGCCGCGAGAAGAAGGAGCGCTTCAGCCTGATCCTGGAGAGCGCC 300
AGCACCAACCAGACCAGCATGTACCTGTGCGCCAGCGGCACCCTGAGCTA 350
CAACGAGCAGTTCTTCGGCCCCGGCACCCGCCTGACCGTGCTGGAGGACC 400
TGAACAAGGTGTTCCCCCCCGAGGTGGCCGTGTTCGAGCCCAGCGAGGCC 450
GAGATCAGCCACACCCAGAAGGCCACCCTGGTGTGCCTGGCCACCGGCTT 500
CTTCCCCGACCACGTGGAGCTGAGCTGGTGGGTGAACGGCAAGGAGGTGC 550
ACAGCGGCGTGTGCACCGACCCCCAGCCCCTGAAGGAGCAGCCCGCCCTG 600
AACGACAGCCGCTACTGCCTGAGCAGCCGCCTGCGCGTGAGCGCCACCTT 650
CTGGCAGAACCCCCGCAACCACTTCCGCTGCCAGGTGCAGTTCTACGGCC 700
TGAGCGAGAACGACGAGTGGACCCAGGACCGCGCCAAGCCCGTGACCCAG 750
ATCGTGAGCGCCGAGGCCTGGGGCCGCGCCGACTGCGGCTTCACCAGCGT 800
GAGCTACCAGCAGGGCGTGCTGAGCGCCACCATCCTGTACGAGATCCTGC 850
TGGGCAAGGCCACCCTGTACGCCGTGCTGGTGAGCGCCCTGGTGCTGATG 900
GCCATGGTGAAGCGCAAGGACTTC [SEQ ID NO: 627]

FIG. 66

Donor Y6W Clone 15 (PYL)

Alpha chain:

ATGAAGAGCCTGCGCGTGCTGCTGGTGATCCTGTGGCTGCAGCTGAGCTG 50
GGTGTGGAGCCAGCAGAAGGAGGTGGAGCAGAACAGCGGCCCCCTGAGCG 100
TGCCCGAGGGCGCCATCGCCAGCCTGAACTGCACCTACAGCGACCGCGGC 150
AGCCAGAGCTTCTTCTGGTACCGCCAGTACAGCGGCAAGAGCCCCGAGCT 200
GATCATGTTCATCTACAGCAACGGCGACAAGGAGGACGGCCGCTTCACCG 250
CCCAGCTGAACAAGGCCAGCCAGTACGTGAGCCTGCTGATCCGCGACAGC 300
CAGCCCAGCGACAGCGCCACCTACCTGTGCGCCGTGAAGGTGGGCACCGG 350
CTTCCAGAAGCTGGTGTTCGGCACCGGCACCCGCCTGCTGGTGAGCCCCA 400
ACATCCAGAACCCCGACCCCGCCGTGTACCAGCTGCGCGACAGCAAGAGC 450
AGCGACAAGAGCGTGTGCCTGTTCACCGACTTCGACAGCCAGACCAACGT 500
GAGCCAGAGCAAGGACAGCGACGTGTACATCACCGACAAGTGCGTGCTGG 550
ACATGCGCAGCATGGACTTCAAGAGCAACAGCGCCGTGGCCTGGAGCAAC 600
AAGAGCGACTTCGCCTGCGCCAACGCCTTCAACAACAGCATCATCCCCGA 650
GGACACCTTCTTCCCCAGCCCCGAGAGCAGCTGCGACGTGAAGCTGGTGG 700
AGAAGAGCTTCGAGACCGACACCAACCTGAACTTCCAGAACCTGAGCGTG 750
ATCGGCTTCCGCATCCTGCTGCTGAAGGTGGCCGGCTTCAACCTGCTGAT 800
GACCCTGCGCCTGTGGAGCAGC [SEQ ID NO: 547]

Beta chain:

ATGGGCACCAGCCTGCTGTGCTGGATGGCCCTGTGCCTGCTGGGCGCCGA 50
CCACGCCGACACCGGCGTGAGCCAGAACCCCCGCCACAAGATCACCAAGC 100
GCGGCCAGAACGTGACCTTCCGCTGCGACCCCATCAGCGAGCACAACCGC 150
CTGTACTGGTACCGCCAGACCCTGGGCCAGGGCCCCGAGTTCCTGACCTA 200
CTTCCAGAACGAGGCCCAGCTGGAGAAGAGCCGCCTGCTGAGCGACCGCT 250
TCAGCGCCGAGCGCCCCAAGGGCAGCTTCAGCACCCTGGAGATCCAGCGC 300
ACCGAGCAGGGCGACAGCGCCATGTACCTGTGCGCCAGCAGCCTGGTGGG 350
CCAGGGCAACACCGAGGCCTTCTTCGGCCAGGGCACCCGCCTGACCGTGG 400
TGGAGGACCTGAACAAGGTGTTCCCCCCCGAGGTGGCCGTGTTCGAGCCC 450
AGCGAGGCCGAGATCAGCCACACCCAGAAGGCCACCCTGGTGTGCCTGGC 500
CACCGGCTTCTTCCCCGACCACGTGGAGCTGAGCTGGTGGGTGAACGGCA 550
AGGAGGTGCACAGCGGCGTGTGCACCGACCCCCAGCCCCTGAAGGAGCAG 600
CCCGCCCTGAACGACAGCCGCTACTGCCTGAGCAGCCGCCTGCGCGTGAG 650
CGCCACCTTCTGGCAGAACCCCCGCAACCACTTCCGCTGCCAGGTGCAGT 700
TCTACGGCCTGAGCGAGAACGACGAGTGGACCCAGGACCGCGCCAAGCCC 750
GTGACCCAGATCGTGAGCGCCGAGGCCTGGGGCCGCGCCGACTGCGGCTT 800
CACCAGCGTGAGCTACCAGCAGGGCGTGCTGAGCGCCACCATCCTGTACG 850
AGATCCTGCTGGGCAAGGCCACCCTGTACGCCGTGCTGGTGAGCGCCCTG 900
GTGCTGATGGCCATGGTGAAGCGCAAGGACTTC [SEQ ID NO: 628]

FIG. 67

TCRs specific for HLA-A*02:01- YLLEMLWRL

Donor N2W Clone 1 (YLL)

Alpha chain:

```
ATGCTGCTGCTGCTGATCCCCGTGCTGGGCATGATCTTCGCCCTGCGCGA      50
CGCCCGCGCCCAGAGCGTGAGCCAGCACAACCACCACGTGATCCTGAGCG      100
AGGCCGCCAGCCTGGAGCTGGGCTGCAACTACAGCTACGGCGGCACCGTG      150
AACCTGTTCTGGTACGTGCAGTACCCCGGCCAGCACCTGCAGCTGCTGCT      200
GAAGTACTTCAGCGGCGACCCCCTGGTGAAGGGCATCAAGGGCTTCGAGG      250
CCGAGTTCATCAAGAGCAAGTTCAGCTTCAACCTGCGCAAGCCCAGCGTG      300
CAGTGGAGCGACACCGCCGAGTACTTCTGCGCCGTGAGCATGCGCTTCGG      350
CGCCGGCACCCGCCTGACCGTGAAGCCCAACATCCAGAACCCCGACCCCG      400
CCGTGTACCAGCTGCGCGACAGCAAGAGCAGCGACAAGAGCGTGTGCCTG      450
TTCACCGACTTCGACAGCCAGACCAACGTGAGCCAGAGCAAGGACAGCGA      500
CGTGTACATCACCGACAAGTGCGTGCTGGACATGCGCAGCATGGACTTCA      550
AGAGCAACAGCGCCGTGGCCTGGAGCAACAAGAGCGACTTCGCCTGCGCC      600
AACGCCTTCAACAACAGCATCATCCCCGAGGACACCTTCTTCCCCAGCCC      650
CGAGAGCAGCTGCGACGTGAAGCTGGTGGAGAAGAGCTTCGAGACCGACA      700
CCAACCTGAACTTCCAGAACCTGAGCGTGATCGGCTTCCGCATCCTGCTG      750
CTGAAGGTGGCCGGCTTCAACCTGCTGATGACCCTGCGCCTGTGGAGCAG      800
C [SEQ ID NO: 548]
```

Beta chain:

```
ATGGGCACCCGCCTGCTGTGCTGGGCCGCCCTGTGCCTGCTGGGCGCCGA      50
GCTGACCGAGGCCGGCGTGGCCCAGAGCCCCCGCTACAAGATCATCGAGA      100
AGCGCCAGAGCGTGGCCTTCTGGTGCAACCCCATCAGCGGCCACGCCACC      150
CTGTACTGGTACCAGCAGATCCTGGGCCAGGGCCCCAAGCTGCTGATCCA      200
GTTCCAGAACAACGGCGTGGTGGACGACAGCCAGCTGCCCAAGGACCGCT      250
TCAGCGCCGAGCGCCTGAAGGGCGTGGACAGCACCCTGAAGATCCAGCCC      300
GCCAAGCTGGAGGACAGCGCCGTGTACCTGTGCGCCAGCAGCCTGGACGA      350
GGGCACCGTGACCTACGAGCAGTACTTCGGCCCCGGCACCCGCCTGACCG      400
TGACCGAGGACCTGAACAAGGTGTTCCCCCCCGAGGTGGCCGTGTTCGAG      450
CCCAGCGAGGCCGAGATCAGCCACACCCAGAAGGCCACCCTGGTGTGCCT      500
GGCCACCGGCTTCTTCCCCGACCACGTGGAGCTGAGCTGGTGGGTGAACG      550
GCAAGGAGGTGCACAGCGGCGTGTGCACCGACCCCCAGCCCCTGAAGGAG      600
CAGCCCGCCCTGAACGACAGCCGCTACTGCCTGAGCAGCCGCCTGCGCGT      650
GAGCGCCACCTTCTGGCAGAACCCCCGCAACCACTTCCGCTGCCAGGTGC      700
AGTTCTACGGCCTGAGCGAGAACGACGAGTGGACCCAGGACCGCGCCAAG      750
CCCGTGACCCAGATCGTGAGCGCCGAGGCCTGGGGCCGCGCCGACTGCGG      800
CTTCACCAGCGTGAGCTACCAGCAGGGCGTGCTGAGCGCCACCATCCTGT      850
ACGAGATCCTGCTGGGCAAGGCCACCCTGTACGCCGTGCTGGTGAGCGCC      900
CTGGTGCTGATGGCCATGGTGAAGCGCAAGGACTTC [SEQ ID NO: 629]
```

FIG. 68

Donor N2W Clone 2 (YLL)

Alpha chain:

ATGAAGAGCCTGCGCGTGCTGCTGGTGATCCTGTGGCTGCAGCTGAGCTG 50
GGTGTGGAGCCAGCAGAAGGAGGTGGAGCAGAACAGCGGCCCCCTGAGCG 100
TGCCCGAGGGCGCCATCGCCAGCCTGAACTGCACCTACAGCGACCGCGGC 150
AGCCAGAGCTTCTTCTGGTACCGCCAGTACAGCGGCAAGAGCCCCGAGCT 200
GATCATGTTCATCTACAGCAACGGCGACAAGGAGGACGGCCGCTTCACCG 250
CCCAGCTGAACAAGGCCAGCCAGTACGTGAGCCTGCTGATCCGCGACAGC 300
CAGCCCAGCGACAGCGCCACCTACCTGTGCGCCGTGAACCCCACCCCCAG 350
CGTGGGCAGCAACTACAAGCTGACCTTCGGCAAGGGCACCCTGCTGACCG 400
TGAACCCCAACATCCAGAACCCCGACCCCGCCGTGTACCAGCTGCGCGAC 450
AGCAAGAGCAGCGACAAGAGCGTGTGCCTGTTCACCGACTTCGACAGCCA 500
GACCAACGTGAGCCAGAGCAAGGACAGCGACGTGTACATCACCGACAAGT 550
GCGTGCTGGACATGCGCAGCATGGACTTCAAGAGCAACAGCGCCGTGGCC 600
TGGAGCAACAAGAGCGACTTCGCCTGCGCCAACGCCTTCAACAACAGCAT 650
CATCCCCGAGGACACCTTCTTCCCCAGCCCCGAGAGCAGCTGCGACGTGA 700
AGCTGGTGGAGAAGAGCTTCGAGACCGACACCAACCTGAACTTCCAGAAC 750
CTGAGCGTGATCGGCTTCCGCATCCTGCTGCTGAAGGTGGCCGGCTTCAA 800
CCTGCTGATGACCCTGCGCCTGTGGAGCAGC [SEQ ID NO: 549]

Beta chain:

ATGGGCTTCCGCCTGCTGTGCTGCGTGGCCTTCTGCCTGCTGGGCGCCGG 50
CCCCGTGGACAGCGGCGTGACCCAGACCCCCAAGCACCTGATCACCGCCA 100
CCGGCCAGCGCGTGACCCTGCGCTGCAGCCCCCGCAGCGGCGACCTGAGC 150
GTGTACTGGTACCAGCAGAGCCTGGACCAGGGCCTGCAGTTCCTGATCCA 200
GTACTACAACGGCGAGGAGCGCGCCAAGGGCAACATCCTGGAGCGCTTCA 250
GCGCCCAGCAGTTCCCCGACCTGCACAGCGAGCTGAACCTGAGCAGCCTG 300
GAGCTGGGCGACAGCGCCCTGTACTTCTGCGCCAGCAGCGTGGGCGGCGA 350
GGGCCTGGCCTTCTTCGGCCAGGGCACCCGCCTGACCGTGGTGGAGGACC 400
TGAACAAGGTGTTCCCCCCCGAGGTGGCCGTGTTCGAGCCCAGCGAGGCC 450
GAGATCAGCCACACCCAGAAGGCCACCCTGGTGTGCCTGGCCACCGGCTT 500
CTTCCCCGACCACGTGGAGCTGAGCTGGTGGGTGAACGGCAAGGAGGTGC 550
ACAGCGGCGTGTGCACCGACCCCCAGCCCCTGAAGGAGCAGCCCGCCCTG 600
AACGACAGCCGCTACTGCCTGAGCAGCCGCCTGCGCGTGAGCGCCACCTT 650
CTGGCAGAACCCCCGCAACCACTTCCGCTGCCAGGTGCAGTTCTACGGCC 700
TGAGCGAGAACGACGAGTGGACCCAGGACCGCGCCAAGCCCGTGACCCAG 750
ATCGTGAGCGCCGAGGCCTGGGGCCGCGCCGACTGCGGCTTCACCAGCGT 800
GAGCTACCAGCAGGGCGTGCTGAGCGCCACCATCCTGTACGAGATCCTGC 850
TGGGCAAGGCCACCCTGTACGCCGTGCTGGTGAGCGCCCTGGTGCTGATG 900
GCCATGGTGAAGCGCAAGGACTTC [SEQ ID NO: 630]

FIG. 69

Donor N2W Clone 3 (YLL)

Alpha chain:

```
ATGATGAAGTGCCCCCAGGCCCTGCTGGCCATCTTCTGGCTGCTGCTGAG    50
CTGGGTGAGCAGCGAGGACAAGGTGGTGCAGAGCCCCCTGAGCCTGGTGG    100
TGCACGAGGGCGACACCGTGACCCTGAACTGCAGCTACGAGGTGACCAAC    150
TTCCGCAGCCTGCTGTGGTACAAGCAGGAGAAGAAGGCCCCCACCTTCCT    200
GTTCATGCTGACCAGCAGCGGCATCGAGAAGAAGAGCGGCCGCCTGAGCA    250
GCATCCTGGACAAGAAGGAGCTGTTCAGCATCCTGAACATCACCGCCACC    300
CAGACCGGCGACAGCGCCGTGTACCTGTGCGCCGTGGCCGCCGAGAACTA    350
CGGCCAGAACTTCGTGTTCGGCCCCGGCACCCGCCTGAGCGTGCTGCCCT    400
ACATCCAGAACCCCGACCCCGCCGTGTACCAGCTGCGCGACAGCAAGAGC    450
AGCGACAAGAGCGTGTGCCTGTTCACCGACTTCGACAGCCAGACCAACGT    500
GAGCCAGAGCAAGGACAGCGACGTGTACATCACCGACAAGTGCGTGCTGG    550
ACATGCGCAGCATGGACTTCAAGAGCAACAGCGCCGTGGCCTGGAGCAAC    600
AAGAGCGACTTCGCCTGCGCCAACGCCTTCAACAACAGCATCATCCCCGA    650
GGACACCTTCTTCCCCAGCCCCGAGAGCAGCTGCGACGTGAAGCTGGTGG    700
AGAAGAGCTTCGAGACCGACACCAACCTGAACTTCCAGAACCTGAGCGTG    750
ATCGGCTTCCGCATCCTGCTGCTGAAGGTGGCCGGCTTCAACCTGCTGAT    800
GACCCTGCGCCTGTGGAGCAGC [SEQ ID NO: 550]
```

Beta chain:

```
ATGGGCACCAGCCTGCTGTGCTGGGTGGTGCTGGGCTTCCTGGGCACCGA    50
CCACACCGGCGCCGGCGTGAGCCAGAGCCCCCGCTACAAGGTGACCAAGC    100
GCGGCCAGGACGTGGCCCTGCGCTGCGACCCCATCAGCGGCCACGTGAGC    150
CTGTACTGGTACCGCCAGGCCCTGGGCCAGGGCCCCGAGTTCCTGACCTA    200
CTTCAACTACGAGGCCCAGCAGGACAAGAGCGGCCTGCCCAACGACCGCT    250
TCAGCGCCGAGCGCCCCGAGGGCAGCATCAGCACCCTGACCATCCAGCGC    300
ACCGAGCAGCGCGACAGCGCCATGTACCGCTGCGCCAGCAGCCTGGAGGG    350
CGACTACAACGAGCAGTTCTTCGGCCCCGGCACCCGCCTGACCGTGCTGG    400
AGGACCTGAACAAGGTGTTCCCCCCCGAGGTGGCCGTGTTCGAGCCCAGC    450
GAGGCCGAGATCAGCCACACCCAGAAGGCCACCCTGGTGTGCCTGGCCAC    500
CGGCTTCTTCCCCGACCACGTGGAGCTGAGCTGGTGGGTGAACGGCAAGG    550
AGGTGCACAGCGGCGTGTGCACCGACCCCCAGCCCCTGAAGGAGCAGCCC    600
GCCCTGAACGACAGCCGCTACTGCCTGAGCAGCCGCCTGCGCGTGAGCGC    650
CACCTTCTGGCAGAACCCCCGCAACCACTTCCGCTGCCAGGTGCAGTTCT    700
ACGGCCTGAGCGAGAACGACGAGTGGACCCAGGACCGCGCCAAGCCCGTG    750
ACCCAGATCGTGAGCGCCGAGGCCTGGGGCCGCGCCGACTGCGGCTTCAC    800
CAGCGTGAGCTACCAGCAGGGCGTGCTGAGCGCCACCATCCTGTACGAGA    850
TCCTGCTGGGCAAGGCCACCCTGTACGCCGTGCTGGTGAGCGCCCTGGTG    900
CTGATGGCCATGGTGAAGCGCAAGGACTTC [SEQ ID NO: 631]
```

FIG. 70

Donor N2W Clone 4 (YLL)

Alpha chain:

ATGGAGAAGAACCCCCTGGCCGCCCCCCTGCTGATCCTGTGGTTCCACCT 50
GGACTGCGTGAGCAGCATCCTGAACGTGGAGCAGAGCCCCCAGAGCCTGC 100
ACGTGCAGGAGGGCGACAGCACCAACTTCACCTGCAGCTTCCCCAGCAGC 150
AACTTCTACGCCCTGCACTGGTACCGCTGGGAGACCGCCAAGAGCCCCGA 200
GGCCCTGTTCGTGATGACCCTGAACGGCGACGAGAAGAAGAAGGGCCGCA 250
TCAGCGCCACCCTGAACACCAAGGAGGGCTACAGCTACCTGTACATCAAG 300
GGCAGCCAGCCCGAGGACAGCGCCACCTACCTGTGCGCCTTCATCAGCAG 350
CGGCAGCGCCCGCCAGCTGACCTTCGGCAGCGGCACCCAGCTGACCGTGC 400
TGCCCGACATCCAGAACCCCGACCCCGCCGTGTACCAGCTGCGCGACAGC 450
AAGAGCAGCGACAAGAGCGTGTGCCTGTTCACCGACTTCGACAGCCAGAC 500
CAACGTGAGCCAGAGCAAGGACAGCGACGTGTACATCACCGACAAGTGCG 550
TGCTGGACATGCGCAGCATGGACTTCAAGAGCAACAGCGCCGTGGCCTGG 600
AGCAACAAGAGCGACTTCGCCTGCGCCAACGCCTTCAACAACAGCATCAT 650
CCCCGAGGACACCTTCTTCCCCAGCCCCGAGAGCAGCTGCGACGTGAAGC 700
TGGTGGAGAAGAGCTTCGAGACCGACACCAACCTGAACTTCCAGAACCTG 750
AGCGTGATCGGCTTCCGCATCCTGCTGCTGAAGGTGGCCGGCTTCAACCT 800
GCTGATGACCCTGCGCCTGTGGAGCAGC [SEQ ID NO: 551]

Beta chain:

ATGGGCACCAGCCTGCTGTGCTGGGTGGTGCTGGGCTTCCTGGGCACCGA 50
CCACACCGGCGCCGGCGTGAGCCAGAGCCCCCGCTACAAGGTGACCAAGC 100
GCGGCCAGGACGTGGCCCTGCGCTGCGACCCCATCAGCGGCCACGTGAGC 150
CTGTACTGGTACCGCCAGGCCCTGGGCCAGGGCCCCGAGTTCCTGACCTA 200
CTTCAACTACGAGGCCCAGCAGGACAAGAGCGGCCTGCCCAACGACCGCT 250
TCAGCGCCGAGCGCCCCGAGGGCAGCATCAGCACCCTGACCATCCAGCGC 300
ACCGAGCAGCGCGACAGCGCCATGTACCGCTGCGCCAGCAGCCTGGAGGC 350
CGACAACGAGAAGCTGTTCTTCGGCAGCGGCACCCAGCTGAGCGTGCTGG 400
AGGACCTGAACAAGGTGTTCCCCCCCGAGGTGGCCGTGTTCGAGCCCAGC 450
GAGGCCGAGATCAGCCACACCCAGAAGGCCACCCTGGTGTGCCTGGCCAC 500
CGGCTTCTTCCCCGACCACGTGGAGCTGAGCTGGTGGGTGAACGGCAAGG 550
AGGTGCACAGCGGCGTGTGCACCGACCCCCAGCCCCTGAAGGAGCAGCCC 600
GCCCTGAACGACAGCCGCTACTGCCTGAGCAGCCGCCTGCGCGTGAGCGC 650
CACCTTCTGGCAGAACCCCCGCAACCACTTCCGCTGCCAGGTGCAGTTCT 700
ACGGCCTGAGCGAGAACGACGAGTGGACCCAGGACCGCGCCAAGCCCGTG 750
ACCCAGATCGTGAGCGCCGAGGCCTGGGGCCGCGCCGACTGCGGCTTCAC 800
CAGCGTGAGCTACCAGCAGGGCGTGCTGAGCGCCACCATCCTGTACGAGA 850
TCCTGCTGGGCAAGGCCACCCTGTACGCCGTGCTGGTGAGCGCCCTGGTG 900
CTGATGGCCATGGTGAAGCGCAAGGACTTC [SEQ ID NO: 632]

FIG. 71

Donor N2W Clone 5 (YLL)

Alpha chain:
ATGAGCCTGAGCAGCCTGCTGAAGGTGGTGACCGCCAGCCTGTGGCTGGG 50
CCCCGGCATCGCCCAGAAGATCACCCAGACCCAGCCCGGCATGTTCGTGC 100
AGGAGAAGGAGGCCGTGACCCTGGACTGCACCTACGACACCAGCGACCAG 150
AGCTACGGCCTGTTCTGGTACAAGCAGCCCAGCAGCGGCGAGATGATCTT 200
CCTGATCTACCAGGGCAGCTACGACGAGCAGAACGCCACCGAGGGCCGCT 250
ACAGCCTGAACTTCCAGAAGGCCCGCAAGAGCGCCAACCTGGTGATCAGC 300
GCCAGCCAGCTGGGCGACAGCGCCATGTACTTCTGCGCCATGCGCGAGGA 350
CCTGCGCAGCAACGACAAGGTGATCTTCGGCCCCGGCACCAGCCTGAGCG 400
TGATCCCCAACATCCAGAACCCCGACCCCGCCGTGTACCAGCTGCGCGAC 450
AGCAAGAGCAGCGACAAGAGCGTGTGCCTGTTCACCGACTTCGACAGCCA 500
GACCAACGTGAGCCAGAGCAAGGACAGCGACGTGTACATCACCGACAAGT 550
GCGTGCTGGACATGCGCAGCATGGACTTCAAGAGCAACAGCGCCGTGGCC 600
TGGAGCAACAAGAGCGACTTCGCCTGCGCCAACGCCTTCAACAACAGCAT 650
CATCCCCGAGGACACCTTCTTCCCCAGCCCCGAGAGCAGCTGCGACGTGA 700
AGCTGGTGGAGAAGAGCTTCGAGACCGACACCAACCTGAACTTCCAGAAC 750
CTGAGCGTGATCGGCTTCCGCATCCTGCTGCTGAAGGTGGCCGGCTTCAA 800
CCTGCTGATGACCCTGCGCCTGTGGAGCAGC [SEQ ID NO: 552]

Beta chain:
ATGGGCTTCCGCCTGCTGTGCTGCGTGGCCTTCTGCCTGCTGGGCGCCGG 50
CCCCGTGGACAGCGGCGTGACCCAGACCCCCAAGCACCTGATCACCGCCA 100
CCGGCCAGCGCGTGACCCTGCGCTGCAGCCCCCGCAGCGGCGACCTGAGC 150
GTGTACTGGTACCAGCAGAGCCTGGACCAGGGCCTGCAGTTCCTGATCCA 200
GTACTACAACGGCGAGGAGCGCGCCAAGGGCAACATCCTGGAGCGCTTCA 250
GCGCCCAGCAGTTCCCCGACCTGCACAGCGAGCTGAACCTGAGCAGCCTG 300
GAGCTGGGCGACAGCGCCCTGTACTTCTGCGCCAGCAGCGTGGGCGACAG 350
CGGCCAGGCCCAGTACTTCGGCCCCGGCACCCGCCTGACCGTGCTGGAGG 400
ACCTGAACAAGGTGTTCCCCCCCGAGGTGGCCGTGTTCGAGCCCAGCGAG 450
GCCGAGATCAGCCACACCCAGAAGGCCACCCTGGTGTGCCTGGCCACCGG 500
CTTCTTCCCCGACCACGTGGAGCTGAGCTGGTGGGTGAACGGCAAGGAGG 550
TGCACAGCGGCGTGTGCACCGACCCCCAGCCCCTGAAGGAGCAGCCCGCC 600
CTGAACGACAGCCGCTACTGCCTGAGCAGCCGCCTGCGCGTGAGCGCCAC 650
CTTCTGGCAGAACCCCCGCAACCACTTCCGCTGCCAGGTGCAGTTCTACG 700
GCCTGAGCGAGAACGACGAGTGGACCCAGGACCGCGCCAAGCCCGTGACC 750
CAGATCGTGAGCGCCGAGGCCTGGGGCCGCGCCGACTGCGGCTTCACCAG 800
CGTGAGCTACCAGCAGGGCGTGCTGAGCGCCACCATCCTGTACGAGATCC 850
TGCTGGGCAAGGCCACCCTGTACGCCGTGCTGGTGAGCGCCCTGGTGCTG 900
ATGGCCATGGTGAAGCGCAAGGACTTC [SEQ ID NO: 633]

FIG. 72

Donor N2W Clone 6 (YLL)

Alpha chain:

ATGCTGCTGCTGCTGATCCCCGTGCTGGGCATGATCTTCGCCCTGCGCGA 50
CGCCCGCGCCCAGAGCGTGAGCCAGCACAACCACCACGTGATCCTGAGCG 100
AGGCCGCCAGCCTGGAGCTGGGCTGCAACTACAGCTACGGCGGCACCGTG 150
AACCTGTTCTGGTACGTGCAGTACCCCGGCCAGCACCTGCAGCTGCTGCT 200
GAAGTACTTCAGCGGCGACCCCCTGGTGAAGGGCATCAAGGGCTTCGAGG 250
CCGAGTTCATCAAGAGCAAGTTCAGCTTCAACCTGCGCAAGCCCAGCGTG 300
CAGTGGAGCGACACCGCCGAGTACTTCTGCGCCGCCGGCGGCGGCAGCCA 350
GGGCAACCTGATCTTCGGCAAGGGCACCAAGCTGAGCGTGAAGCCCAACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 553]

Beta chain:

ATGGGCCCCGGCCTGCTGTGCTGGGCCCTGCTGTGCCTGCTGGGCGCCGG 50
CCTGGTGGACGCCGGCGTGACCCAGAGCCCCACCCACCTGATCAAGACCC 100
GCGGCCAGCAGGTGACCCTGCGCTGCAGCCCCAAGAGCGGCCACGACACC 150
GTGAGCTGGTACCAGCAGGCCCTGGGCCAGGGCCCCCAGTTCATCTTCCA 200
GTACTACGAGGAGGAGGAGCGCCAGCGCGGCAACTTCCCCGACCGCTTCA 250
GCGGCCACCAGTTCCCCAACTACAGCAGCGAGCTGAACGTGAACGCCCTG 300
CTGCTGGGCGACAGCGCCCTGTACCTGTGCGCCAGCAGCTGGTGGGACGG 350
CGGCACCGGCGAGCTGTTCTTCGGCGAGGGCAGCCGCCTGACCGTGCTGG 400
AGGACCTGAACAAGGTGTTCCCCCCCGAGGTGGCCGTGTTCGAGCCCAGC 450
GAGGCCGAGATCAGCCACACCCAGAAGGCCACCCTGGTGTGCCTGGCCAC 500
CGGCTTCTTCCCCGACCACGTGGAGCTGAGCTGGTGGGTGAACGGCAAGG 550
AGGTGCACAGCGGCGTGTGCACCGACCCCCAGCCCCTGAAGGAGCAGCCC 600
GCCCTGAACGACAGCCGCTACTGCCTGAGCAGCCGCCTGCGCGTGAGCGC 650
CACCTTCTGGCAGAACCCCCGCAACCACTTCCGCTGCCAGGTGCAGTTCT 700
ACGGCCTGAGCGAGAACGACGAGTGGACCCAGGACCGCGCCAAGCCCGTG 750
ACCCAGATCGTGAGCGCCGAGGCCTGGGGCCGCGCCGACTGCGGCTTCAC 800
CAGCGTGAGCTACCAGCAGGGCGTGCTGAGCGCCACCATCCTGTACGAGA 850
TCCTGCTGGGCAAGGCCACCCTGTACGCCGTGCTGGTGAGCGCCCTGGTG 900
CTGATGGCCATGGTGAAGCGCAAGGACTTC [SEQ ID NO: 634]

FIG. 73

Donor B87 Clone 1 (YLL)

Alpha chain:
ATGAGCCTGAGCAGCCTGCTGAAGGTGGTGACCGCCAGCCTGTGGCTGGG 50
CCCCGGCATCGCCCAGAAGATCACCCAGACCCAGCCCGGCATGTTCGTGC 100
AGGAGAAGGAGGCCGTGACCCTGGACTGCACCTACGACACCAGCGACCCC 150
AGCTACGGCCTGTTCTGGTACAAGCAGCCCAGCAGCGGCGAGATGATCTT 200
CCTGATCTACCAGGGCAGCTACGACCAGCAGAACGCCACCGAGGGCCGCT 250
ACAGCCTGAACTTCCAGAAGGCCCGCAAGAGCGCCAACCTGGTGATCAGC 300
GCCAGCCAGCTGGGCGACAGCGCCATGTACTTCTGCGCCATGCGCGAGCT 350
GAACGACTACAAGCTGAGCTTCGGCGCCGGCACCACCGTGACCGTGCGCG 400
CCAACATCCAGAACCCCGACCCCGCCGTGTACCAGCTGCGCGACAGCAAG 450
AGCAGCGACAAGAGCGTGTGCCTGTTCACCGACTTCGACAGCCAGACCAA 500
CGTGAGCCAGAGCAAGGACAGCGACGTGTACATCACCGACAAGTGCGTGC 550
TGGACATGCGCAGCATGGACTTCAAGAGCAACAGCGCCGTGGCCTGGAGC 600
AACAAGAGCGACTTCGCCTGCGCCAACGCCTTCAACAACAGCATCATCCC 650
CGAGGACACCTTCTTCCCCAGCCCCGAGAGCAGCTGCGACGTGAAGCTGG 700
TGGAGAAGAGCTTCGAGACCGACACCAACCTGAACTTCCAGAACCTGAGC 750
GTGATCGGCTTCCGCATCCTGCTGCTGAAGGTGGCCGGCTTCAACCTGCT 800
GATGACCCTGCGCCTGTGGAGCAGC [SEQ ID NO: 554]

Beta chain:
ATGGCCAGCCTGCTGTTCTTCTGCGGCGCCTTCTACCTGCTGGGCACCGG 50
CAGCATGGACGCCGACGTGACCCAGACCCCCCGCAACCGCATCACCAAGA 100
CCGGCAAGCGCATCATGCTGGAGTGCAGCCAGACCAAGGGCCACGACCGC 150
ATGTACTGGTACCGCCAGGACCCCGGCCTGGGCCTGCGCCTGATCTACTA 200
CAGCTTCGACGTGAAGGACATCAACAAGGGCGAGATCAGCGACGGCTACA 250
GCGTGAGCCGCCAGGCCCAGGCCAAGTTCAGCCTGAGCCTGGAGAGCGCC 300
ATCCCCAACCAGACCGCCCTGTACTTCTGCGCCACCCGCGACGACCTGCT 350
GGCCGAGGCCTTCTTCGGCCAGGGCACCCGCCTGACCGTGGTGGAGGACC 400
TGAACAAGGTGTTCCCCCCCGAGGTGGCCGTGTTCGAGCCCAGCGAGGCC 450
GAGATCAGCCACACCCAGAAGGCCACCCTGGTGTGCCTGGCCACCGGCTT 500
CTTCCCCGACCACGTGGAGCTGAGCTGGTGGGTGAACGGCAAGGAGGTGC 550
ACAGCGGCGTGTGCACCGACCCCCAGCCCCTGAAGGAGCAGCCCGCCCTG 600
AACGACAGCCGCTACTGCCTGAGCAGCCGCCTGCGCGTGAGCGCCACCTT 650
CTGGCAGAACCCCCGCAACCACTTCCGCTGCCAGGTGCAGTTCTACGGCC 700
TGAGCGAGAACGACGAGTGGACCCAGGACCGCGCCAAGCCCGTGACCCAG 750
ATCGTGAGCGCCGAGGCCTGGGGCCGCGCCGACTGCGGCTTCACCAGCGT 800
GAGCTACCAGCAGGGCGTGCTGAGCGCCACCATCCTGTACGAGATCCTGC 850
TGGGCAAGGCCACCCTGTACGCCGTGCTGGTGAGCGCCCTGGTGCTGATG 900
GCCATGGTGAAGCGCAAGGACTTC [SEQ ID NO: 635]

FIG. 74

Donor B87 Clone 2 (YLL)

Alpha chain:
ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCACCGACGGCCTGCCCCGCTT 350
CGGCGCCGGCACCCGCCTGACCGTGAAGCCCAACATCCAGAACCCCGACC 400
CCGCCGTGTACCAGCTGCGCGACAGCAAGAGCAGCGACAAGAGCGTGTGC 450
CTGTTCACCGACTTCGACAGCCAGACCAACGTGAGCCAGAGCAAGGACAG 500
CGACGTGTACATCACCGACAAGTGCGTGCTGGACATGCGCAGCATGGACT 550
TCAAGAGCAACAGCGCCGTGGCCTGGAGCAACAAGAGCGACTTCGCCTGC 600
GCCAACGCCTTCAACAACAGCATCATCCCCGAGGACACCTTCTTCCCCAG 650
CCCCGAGAGCAGCTGCGACGTGAAGCTGGTGGAGAAGAGCTTCGAGACCG 700
ACACCAACCTGAACTTCCAGAACCTGAGCGTGATCGGCTTCCGCATCCTG 750
CTGCTGAAGGTGGCCGGCTTCAACCTGCTGATGACCCTGCGCCTGTGGAG 800
CAGC [SEQ ID NO: 555]

Beta chain:
ATGCTGAGCCCCGACCTGCCCGACAGCGCCTGGAACACCCGCCTGCTGTG 50
CCACGTGATGCTGTGCCTGCTGGGCGCCGTGAGCGTGGCCGCCGGCGTGA 100
TCCAGAGCCCCCGCCACCTGATCAAGGAGAAGCGCGAGACCGCCACCCTG 150
AAGTGCTACCCCATCCCCCGCCACGACACCGTGTACTGGTACCAGCAGGG 200
CCCCGGCCAGGACCCCCAGTTCCTGATCAGCTTCTACGAGAAGATGCAGA 250
GCGACAAGGGCAGCATCCCCGACCGCTTCAGCGCCCAGCAGTTCAGCGAC 300
TACCACAGCGAGCTGAACATGAGCAGCCTGGAGCTGGGCGACAGCGCCCT 350
GTACTTCTGCGCCAGCAGCTTCGGCACCAACACCGGCGAGCTGTTCTTCG 400
GCGAGGGCAGCCGCCTGACCGTGCTGGAGGACCTGAACAAGGTGTTCCCC 450
CCCGAGGTGGCCGTGTTCGAGCCCAGCGAGGCCGAGATCAGCCACACCCA 500
GAAGGCCACCCTGGTGTGCCTGGCCACCGGCTTCTTCCCCGACCACGTGG 550
AGCTGAGCTGGTGGGTGAACGGCAAGGAGGTGCACAGCGGCGTGTGCACC 600
GACCCCCAGCCCCTGAAGGAGCAGCCCGCCCTGAACGACAGCCGCTACTG 650
CCTGAGCAGCCGCCTGCGCGTGAGCGCCACCTTCTGGCAGAACCCCCGCA 700
ACCACTTCCGCTGCCAGGTGCAGTTCTACGGCCTGAGCGAGAACGACGAG 750
TGGACCCAGGACCGCGCCAAGCCCGTGACCCAGATCGTGAGCGCCGAGGC 800
CTGGGGCCGCGCCGACTGCGGCTTCACCAGCGTGAGCTACCAGCAGGGCG 850
TGCTGAGCGCCACCATCCTGTACGAGATCCTGCTGGGCAAGGCCACCCTG 900
TACGCCGTGCTGGTGAGCGCCCTGGTGCTGATGGCCATGGTGAAGCGCAA 950
GGACTTC [SEQ ID NO: 636]

FIG. 75

Donor B87 Clone 3 (YLL)

Alpha chain:

```
ATGCTGCTGCTGCTGATCCCCGTGCTGGGCATGATCTTCGCCCTGCGCGA   50
CGCCCGCGCCCAGAGCGTGAGCCAGCACAACCACCACGTGATCCTGAGCG   100
AGGCCGCCAGCCTGGAGCTGGGCTGCAACTACAGCTACGGCGGCACCGTG   150
AACCTGTTCTGGTACGTGCAGTACCCCGGCCAGCACCTGCAGCTGCTGCT   200
GAAGTACTTCAGCGGCGACCCCCTGGTGAAGGGCATCAAGGGCTTCGAGG   250
CCGAGTTCATCAAGAGCAAGTTCAGCTTCAACCTGCGCAAGCCCAGCGTG   300
CAGTGGAGCGACACCGCCGAGTACTTCTGCGCCGTGAACCGCCCCAGCGG   350
CGGCAGCAACTACAAGCTGACCTTCGGCAAGGGCACCCTGCTGACCGTGA   400
ACCCCAACATCCAGAACCCCGACCCCGCCGTGTACCAGCTGCGCGACAGC   450
AAGAGCAGCGACAAGAGCGTGTGCCTGTTCACCGACTTCGACAGCCAGAC   500
CAACGTGAGCCAGAGCAAGGACAGCGACGTGTACATCACCGACAAGTGCG   550
TGCTGGACATGCGCAGCATGGACTTCAAGAGCAACAGCGCCGTGGCCTGG   600
AGCAACAAGAGCGACTTCGCCTGCGCCAACGCCTTCAACAACAGCATCAT   650
CCCCGAGGACACCTTCTTCCCCAGCCCCGAGAGCAGCTGCGACGTGAAGC   700
TGGTGGAGAAGAGCTTCGAGACCGACACCAACCTGAACTTCCAGAACCTG   750
AGCGTGATCGGCTTCCGCATCCTGCTGCTGAAGGTGGCCGGCTTCAACCT   800
GCTGATGACCCTGCGCCTGTGGAGCAGC [SEQ ID NO: 556]
```

Beta chain:

```
ATGAGCACCCGCCTGCTGTGCTGGATGGCCCTGTGCCTGCTGGGCGCCGA   50
GCTGAGCGAGGCCGAGGTGGCCCAGAGCCCCCGCTACAAGATCACCGAGA   100
AGAGCCAGGCCGTGGCCTTCTGGTGCGACCCCATCAGCGGCCACGCCACC   150
CTGTACTGGTACCGCCAGATCCTGGGCCAGGGCCCCGAGCTGCTGGTGCA   200
GTTCCAGGACGAGAGCGTGGTGGACGACAGCCAGCTGCCCAAGGACCGCT   250
TCAGCGCCGAGCGCCTGAAGGGCGTGGACAGCACCCTGAAGATCCAGCCC   300
GCCGAGCTGGGCGACAGCGCCATGTACCTGTGCGCCAGCAGCTTCGGCCA   350
GTACAACGAGCAGTTCTTCGGCCCCGGCACCCGCCTGACCGTGCTGGAGG   400
ACCTGAACAAGGTGTTCCCCCCCGAGGTGGCCGTGTTCGAGCCCAGCGAG   450
GCCGAGATCAGCCACACCCAGAAGGCCACCCTGGTGTGCCTGGCCACCGG   500
CTTCTTCCCCGACCACGTGGAGCTGAGCTGGTGGGTGAACGGCAAGGAGG   550
TGCACAGCGGCGTGTGCACCGACCCCCAGCCCCTGAAGGAGCAGCCCGCC   600
CTGAACGACAGCCGCTACTGCCTGAGCAGCCGCCTGCGCGTGAGCGCCAC   650
CTTCTGGCAGAACCCCCGCAACCACTTCCGCTGCCAGGTGCAGTTCTACG   700
GCCTGAGCGAGAACGACGAGTGGACCCAGGACCGCGCCAAGCCCGTGACC   750
CAGATCGTGAGCGCCGAGGCCTGGGGCCGCGCCGACTGCGGCTTCACCAG   800
CGTGAGCTACCAGCAGGGCGTGCTGAGCGCCACCATCCTGTACGAGATCC   850
TGCTGGGCAAGGCCACCCTGTACGCCGTGCTGGTGAGCGCCCTGGTGCTG   900
ATGGCCATGGTGAAGCGCAAGGACTTC [SEQ ID NO: 637]
```

FIG. 76

TCRs specific for HLA-A*02:01-FLYALALLL

Donor J9B Clone 1 (FLY)

Alpha chain:

```
ATGGAGACCCTGCTGGGCGTGAGCCTGGTGATCCTGTGGCTGCAGCTGGC    50
CCGCGTGAACAGCCAGCAGGGCGAGGAGGACCCCCAGGCCCTGAGCATCC    100
AGGAGGGCGAGAACGCCACCATGAACTGCAGCTACAAGACCAGCATCAAC    150
AACCTGCAGTGGTACCGCCAGAACAGCGGCCGCGGCCTGGTGCACCTGAT    200
CCTGATCCGCAGCAACGAGCGCGAGAAGCACAGCGGCCGCCTGCGCGTGA    250
CCCTGGACACCAGCAAGAAGAGCAGCAGCCTGCTGATCACCGCCAGCCGC    300
GCCGCCGACACCGCCAGCTACTTCTGCGCCACCACCGGCAACAGCGGCTA    350
CAGCACCCTGACCTTCGGCAAGGGCACCATGCTGCTGGTGAGCCCCGACA    400
TCCAGAACCCCGACCCCGCCGTGTACCAGCTGCGCGACAGCAAGAGCAGC    450
GACAAGAGCGTGTGCCTGTTCACCGACTTCGACAGCCAGACCAACGTGAG    500
CCAGAGCAAGGACAGCGACGTGTACATCACCGACAAGTGCGTGCTGGACA    550
TGCGCAGCATGGACTTCAAGAGCAACAGCGCCGTGGCCTGGAGCAACAAG    600
AGCGACTTCGCCTGCGCCAACGCCTTCAACAACAGCATCATCCCCGAGGA    650
CACCTTCTTCCCCAGCCCCGAGAGCAGCTGCGACGTGAAGCTGGTGGAGA    700
AGAGCTTCGAGACCGACACCAACCTGAACTTCCAGAACCTGAGCGTGATC    750
GGCTTCCGCATCCTGCTGCTGAAGGTGGCCGGCTTCAACCTGCTGATGAC    800
CCTGCGCCTGTGGAGCAGC  [SEQ ID NO: 557]
```

Beta chain:

```
ATGAGCATCGGCCTGCTGTGCTGCGCCGCCCTGAGCCTGCTGTGGGCCGG    50
CCCCGTGAACGCCGGCGTGACCCAGACCCCCAAGTTCCAGGTGCTGAAGA    100
CCGGCCAGAGCATGACCCTGCAGTGCGCCCAGGACATGAACCACGAGTAC    150
ATGAGCTGGTACCGCCAGGACCCCGGCATGGGCCTGCGCCTGATCCACTA    200
CAGCGTGGGCGCCGGCATCACCGACCAGGGCGAGGTGCCCAACGGCTACA    250
ACGTGAGCCGCAGCACCACCGAGGACTTCCCCCTGCGCCTGCTGAGCGCC    300
GCCCCCAGCCAGACCAGCGTGTACTTCTGCGCCAGCAGCTACGGCGGCGG    350
CTACTACGGCTACACCTTCGGCAGCGGCACCCGCCTGACCGTGGTGGAGG    400
ACCTGAACAAGGTGTTCCCCCCCGAGGTGGCCGTGTTCGAGCCCAGCGAG    450
GCCGAGATCAGCCACACCCAGAAGGCCACCCTGGTGTGCCTGGCCACCGG    500
CTTCTTCCCCGACCACGTGGAGCTGAGCTGGTGGGTGAACGGCAAGGAGG    550
TGCACAGCGGCGTGTGCACCGACCCCCAGCCCCTGAAGGAGCAGCCCGCC    600
CTGAACGACAGCCGCTACTGCCTGAGCAGCCGCCTGCGCGTGAGCGCCAC    650
CTTCTGGCAGAACCCCCGCAACCACTTCCGCTGCCAGGTGCAGTTCTACG    700
GCCTGAGCGAGAACGACGAGTGGACCCAGGACCGCGCCAAGCCCGTGACC    750
CAGATCGTGAGCGCCGAGGCCTGGGGCCGCGCCGACTGCGGCTTCACCAG    800
CGTGAGCTACCAGCAGGGCGTGCTGAGCGCCACCATCCTGTACGAGATCC    850
TGCTGGGCAAGGCCACCCTGTACGCCGTGCTGGTGAGCGCCCTGGTGCTG    900
ATGGCCATGGTGAAGCGCAAGGACTTC  [SEQ ID NO: 638]
```

FIG. 77

Donor J9B Clone 2 (FLY)

Alpha chain:

ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCCGCGTGGGCGACAGCGGCTA 350
CAGCACCCTGACCTTCGGCAAGGGCACCATGCTGCTGGTGAGCCCCGACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 558]

Beta chain:

ATGAGCATCGGCCTGCTGTGCTGCGCCGCCCTGAGCCTGCTGTGGGCCGG 50
CCCCGTGAACGCCGGCGTGACCCAGACCCCCAAGTTCCAGGTGCTGAAGA 100
CCGGCCAGAGCATGACCCTGCAGTGCGCCCAGGACATGAACCACGAGTAC 150
ATGAGCTGGTACCGCCAGGACCCCGGCATGGGCCTGCGCCTGATCCACTA 200
CAGCGTGGGCGCCGGCATCACCGACCAGGGCGAGGTGCCCAACGGCTACA 250
ACGTGAGCCGCAGCACCACCGAGGACTTCCCCCTGCGCCTGCTGAGCGCC 300
GCCCCCAGCCAGACCAGCGTGTACTTCTGCGCCAGCAGCTACCAGGGCAC 350
CGGCGCCTACGGCTACACCTTCGGCAGCGGCACCCGCCTGACCGTGGTGG 400
AGGACCTGAACAAGGTGTTCCCCCCCGAGGTGGCCGTGTTCGAGCCCAGC 450
GAGGCCGAGATCAGCCACACCCAGAAGGCCACCCTGGTGTGCCTGGCCAC 500
CGGCTTCTTCCCCGACCACGTGGAGCTGAGCTGGTGGGTGAACGGCAAGG 550
AGGTGCACAGCGGCGTGTGCACCGACCCCCAGCCCCTGAAGGAGCAGCCC 600
GCCCTGAACGACAGCCGCTACTGCCTGAGCAGCCGCCTGCGCGTGAGCGC 650
CACCTTCTGGCAGAACCCCCGCAACCACTTCCGCTGCCAGGTGCAGTTCT 700
ACGGCCTGAGCGAGAACGACGAGTGGACCCAGGACCGCGCCAAGCCCGTG 750
ACCCAGATCGTGAGCGCCGAGGCCTGGGGCCGCGCCGACTGCGGCTTCAC 800
CAGCGTGAGCTACCAGCAGGGCGTGCTGAGCGCCACCATCCTGTACGAGA 850
TCCTGCTGGGCAAGGCCACCCTGTACGCCGTGCTGGTGAGCGCCCTGGTG 900
CTGATGGCCATGGTGAAGCGCAAGGACTTC [SEQ ID NO: 639]

FIG. 78

Donor A5L Clone 1 (FLY)

Alpha chain:

ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCACCGAGGGCGACAGCGGCTA 350
CAGCACCCTGACCTTCGGCAAGGGCACCATGCTGCTGGTGAGCCCCGACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 559]

Beta chain:

ATGAGCATCGGCCTGCTGTGCTGCGCCGCCCTGAGCCTGCTGTGGGCCGG 50
CCCCGTGAACGCCGGCGTGACCCAGACCCCCAAGTTCCAGGTGCTGAAGA 100
CCGGCCAGAGCATGACCCTGCAGTGCGCCCAGGACATGAACCACGAGTAC 150
ATGAGCTGGTACCGCCAGGACCCCGGCATGGGCCTGCGCCTGATCCACTA 200
CAGCGTGGGCGCCGGCATCACCGACCAGGGCGAGGTGCCCAACGGCTACA 250
ACGTGAGCCGCAGCACCACCGAGGACTTCCCCCTGCGCCTGCTGAGCGCC 300
GCCCCCAGCCAGACCAGCGTGTACTTCTGCGCCAGCAGCTACCAGGGCGG 350
CAGCTACGGCTACACCTTCGGCAGCGGCACCCGCCTGACCGTGGTGGAGG 400
ACCTGAACAAGGTGTTCCCCCCCGAGGTGGCCGTGTTCGAGCCCAGCGAG 450
GCCGAGATCAGCCACACCCAGAAGGCCACCCTGGTGTGCCTGGCCACCGG 500
CTTCTTCCCCGACCACGTGGAGCTGAGCTGGTGGGTGAACGGCAAGGAGG 550
TGCACAGCGGCGTGTGCACCGACCCCCAGCCCCTGAAGGAGCAGCCCGCC 600
CTGAACGACAGCCGCTACTGCCTGAGCAGCCGCCTGCGCGTGAGCGCCAC 650
CTTCTGGCAGAACCCCCGCAACCACTTCCGCTGCCAGGTGCAGTTCTACG 700
GCCTGAGCGAGAACGACGAGTGGACCCAGGACCGCGCCAAGCCCGTGACC 750
CAGATCGTGAGCGCCGAGGCCTGGGGCCGCGCCGACTGCGGCTTCACCAG 800
CGTGAGCTACCAGCAGGGCGTGCTGAGCGCCACCATCCTGTACGAGATCC 850
TGCTGGGCAAGGCCACCCTGTACGCCGTGCTGGTGAGCGCCCTGGTGCTG 900
ATGGCCATGGTGAAGCGCAAGGACTTC [SEQ ID NO: 640]

FIG. 79

Donor A5L Clone 2 (FLY)

Alpha chain:

```
ATGGAGACCCTGCTGGGCGTGAGCCTGGTGATCCTGTGGCTGCAGCTGGC    50
CCGCGTGAACAGCCAGCAGGGCGAGGAGGACCCCCAGGCCCTGAGCATCC    100
AGGAGGGCGAGAACGCCACCATGAACTGCAGCTACAAGACCAGCATCAAC    150
AACCTGCAGTGGTACCGCCAGAACAGCGGCCGCGGCCTGGTGCACCTGAT    200
CCTGATCCGCAGCAACGAGCGCGAGAAGCACAGCGGCCGCCTGCGCGTGA    250
CCCTGGACACCAGCAAGAAGAGCAGCAGCCTGCTGATCACCGCCAGCCGC    300
GCCGCCGACACCGCCAGCTACTTCTGCGCCACCGAGGGCGACAGCGGCTA    350
CAGCACCCTGACCTTCGGCAAGGGCACCATGCTGCTGGTGAGCCCCGACA    400
TCCAGAACCCCGACCCCGCCGTGTACCAGCTGCGCGACAGCAAGAGCAGC    450
GACAAGAGCGTGTGCCTGTTCACCGACTTCGACAGCCAGACCAACGTGAG    500
CCAGAGCAAGGACAGCGACGTGTACATCACCGACAAGTGCGTGCTGGACA    550
TGCGCAGCATGGACTTCAAGAGCAACAGCGCCGTGGCCTGGAGCAACAAG    600
AGCGACTTCGCCTGCGCCAACGCCTTCAACAACAGCATCATCCCCGAGGA    650
CACCTTCTTCCCCAGCCCCGAGAGCAGCTGCGACGTGAAGCTGGTGGAGA    700
AGAGCTTCGAGACCGACACCAACCTGAACTTCCAGAACCTGAGCGTGATC    750
GGCTTCCGCATCCTGCTGCTGAAGGTGGCCGGCTTCAACCTGCTGATGAC    800
CCTGCGCCTGTGGAGCAGC [SEQ ID NO: 560]
```

Beta chain:

```
ATGAGCATCGGCCTGCTGTGCTGCGCCGCCCTGAGCCTGCTGTGGGCCGG    50
CCCCGTGAACGCCGGCGTGACCCAGACCCCCAAGTTCCAGGTGCTGAAGA    100
CCGGCCAGAGCATGACCCTGCAGTGCGCCCAGGACATGAACCACGAGTAC    150
ATGAGCTGGTACCGCCAGGACCCCGGCATGGGCCTGCGCCTGATCCACTA    200
CAGCGTGGGCGCCGGCATCACCGACCAGGGCGAGGTGCCCAACGGCTACA    250
ACGTGAGCCGCAGCACCACCGAGGACTTCCCCCTGCGCCTGCTGAGCGCC    300
GCCCCCAGCCAGACCAGCGTGTACTTCTGCGCCAGCAGCCGCCAGGGCGG    350
CAGCTACGGCTACACCTTCGGCAGCGGCACCCGCCTGACCGTGGTGGAGG    400
ACCTGAACAAGGTGTTCCCCCCCGAGGTGGCCGTGTTCGAGCCCAGCGAG    450
GCCGAGATCAGCCACACCCAGAAGGCCACCCTGGTGTGCCTGGCCACCGG    500
CTTCTTCCCCGACCACGTGGAGCTGAGCTGGTGGGTGAACGGCAAGGAGG    550
TGCACAGCGGCGTGTGCACCGACCCCCAGCCCCTGAAGGAGCAGCCCGCC    600
CTGAACGACAGCCGCTACTGCCTGAGCAGCCGCCTGCGCGTGAGCGCCAC    650
CTTCTGGCAGAACCCCCGCAACCACTTCCGCTGCCAGGTGCAGTTCTACG    700
GCCTGAGCGAGAACGACGAGTGGACCCAGGACCGCGCCAAGCCCGTGACC    750
CAGATCGTGAGCGCCGAGGCCTGGGGCCGCGCCGACTGCGGCTTCACCAG    800
CGTGAGCTACCAGCAGGGCGTGCTGAGCGCCACCATCCTGTACGAGATCC    850
TGCTGGGCAAGGCCACCCTGTACGCCGTGCTGGTGAGCGCCCTGGTGCTG    900
ATGGCCATGGTGAAGCGCAAGGACTTC [SEQ ID NO: 641]
```

FIG. 80

Donor A5L Clone 3 (FLY)

Alpha chain:
ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCACCGAGGGCGACAGCGGCTA 350
CAGCACCCTGACCTTCGGCAAGGGCACCATGCTGCTGGTGAGCCCCGACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 561]

Beta chain:
ATGAGCATCGGCCTGCTGTGCTGCGCCGCCCTGAGCCTGCTGTGGGCCGG 50
CCCCGTGAACGCCGGCGTGACCCAGACCCCCAAGTTCCAGGTGCTGAAGA 100
CCGGCCAGAGCATGACCCTGCAGTGCGCCCAGGACATGAACCACGAGTAC 150
ATGAGCTGGTACCGCCAGGACCCCGGCATGGGCCTGCGCCTGATCCACTA 200
CAGCGTGGGCGCCGGCATCACCGACCAGGGCGAGGTGCCCAACGGCTACA 250
ACGTGAGCCGCAGCACCACCGAGGACTTCCCCCTGCGCCTGCTGAGCGCC 300
GCCCCCAGCCAGACCAGCGTGTACTTCTGCGCCAGCAGCCCCCAGGGCGG 350
CAACTACGGCTACACCTTCGGCAGCGGCACCCGCCTGACCGTGGTGGAGG 400
ACCTGAACAAGGTGTTCCCCCCCGAGGTGGCCGTGTTCGAGCCCAGCGAG 450
GCCGAGATCAGCCACACCCAGAAGGCCACCCTGGTGTGCCTGGCCACCGG 500
CTTCTTCCCCGACCACGTGGAGCTGAGCTGGTGGGTGAACGGCAAGGAGG 550
TGCACAGCGGCGTGTGCACCGACCCCCAGCCCCTGAAGGAGCAGCCCGCC 600
CTGAACGACAGCCGCTACTGCCTGAGCAGCCGCCTGCGCGTGAGCGCCAC 650
CTTCTGGCAGAACCCCCGCAACCACTTCCGCTGCCAGGTGCAGTTCTACG 700
GCCTGAGCGAGAACGACGAGTGGACCCAGGACCGCGCCAAGCCCGTGACC 750
CAGATCGTGAGCGCCGAGGCCTGGGGCCGCGCCGACTGCGGCTTCACCAG 800
CGTGAGCTACCAGCAGGGCGTGCTGAGCGCCACCATCCTGTACGAGATCC 850
TGCTGGGCAAGGCCACCCTGTACGCCGTGCTGGTGAGCGCCCTGGTGCTG 900
ATGGCCATGGTGAAGCGCAAGGACTTC [SEQ ID NO: 642]

FIG. 81

Donor A5L Clone 4 (FLY)

Alpha chain:

ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCACCAGCGGCGACAGCGGCTA 350
CAGCACCCTGACCTTCGGCAAGGGCACCATGCTGCTGGTGAGCCCCGACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 562]

Beta chain:

ATGAGCATCGGCCTGCTGTGCTGCGCCGCCCTGAGCCTGCTGTGGGCCGG 50
CCCCGTGAACGCCGGCGTGACCCAGACCCCCAAGTTCCAGGTGCTGAAGA 100
CCGGCCAGAGCATGACCCTGCAGTGCGCCCAGGACATGAACCACGAGTAC 150
ATGAGCTGGTACCGCCAGGACCCCGGCATGGGCCTGCGCCTGATCCACTA 200
CAGCGTGGGCGCCGGCATCACCGACCAGGGCGAGGTGCCCAACGGCTACA 250
ACGTGAGCCGCAGCACCACCGAGGACTTCCCCCTGCGCCTGCTGAGCGCC 300
GCCCCCAGCCAGACCAGCGTGTACTTCTGCGCCAGCAGCCCCCAGGGCGG 350
CAACTACGGCTACACCTTCGGCAGCGGCACCCGCCTGACCGTGGTGGAGG 400
ACCTGAACAAGGTGTTCCCCCCCGAGGTGGCCGTGTTCGAGCCCAGCGAG 450
GCCGAGATCAGCCACACCCAGAAGGCCACCCTGGTGTGCCTGGCCACCGG 500
CTTCTTCCCCGACCACGTGGAGCTGAGCTGGTGGGTGAACGGCAAGGAGG 550
TGCACAGCGGCGTGTGCACCGACCCCCAGCCCCTGAAGGAGCAGCCCGCC 600
CTGAACGACAGCCGCTACTGCCTGAGCAGCCGCCTGCGCGTGAGCGCCAC 650
CTTCTGGCAGAACCCCCGCAACCACTTCCGCTGCCAGGTGCAGTTCTACG 700
GCCTGAGCGAGAACGACGAGTGGACCCAGGACCGCGCCAAGCCCGTGACC 750
CAGATCGTGAGCGCCGAGGCCTGGGGCCGCGCCGACTGCGGCTTCACCAG 800
CGTGAGCTACCAGCAGGGCGTGCTGAGCGCCACCATCCTGTACGAGATCC 850
TGCTGGGCAAGGCCACCCTGTACGCCGTGCTGGTGAGCGCCCTGGTGCTG 900
ATGGCCATGGTGAAGCGCAAGGACTTC [SEQ ID NO: 643]

FIG. 82

Donor A5L Clone 5 (FLY)

Alpha chain:

ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCACCGTGGGCAACAGCGGCTA 350
CAGCACCCTGACCTTCGGCAAGGGCACCATGCTGCTGGTGAGCCCCGACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 563]

Beta chain:

ATGAGCATCGGCCTGCTGTGCTGCGCCGCCCTGAGCCTGCTGTGGGCCGG 50
CCCCGTGAACGCCGGCGTGACCCAGACCCCCAAGTTCCAGGTGCTGAAGA 100
CCGGCCAGAGCATGACCCTGCAGTGCGCCCAGGACATGAACCACGAGTAC 150
ATGAGCTGGTACCGCCAGGACCCCGGCATGGGCCTGCGCCTGATCCACTA 200
CAGCGTGGGCGCCGGCATCACCGACCAGGGCGAGGTGCCCAACGGCTACA 250
ACGTGAGCCGCAGCACCACCGAGGACTTCCCCCTGCGCCTGCTGAGCGCC 300
GCCCCCAGCCAGACCAGCGTGTACTTCTGCGCCAGCAGCTTCCAGGGCGG 350
CAACGAGCAGTTCTTCGGCCCCGGCACCCGCCTGACCGTGCTGGAGGACC 400
TGAACAAGGTGTTCCCCCCCGAGGTGGCCGTGTTCGAGCCCAGCGAGGCC 450
GAGATCAGCCACACCCAGAAGGCCACCCTGGTGTGCCTGGCCACCGGCTT 500
CTTCCCCGACCACGTGGAGCTGAGCTGGTGGGTGAACGGCAAGGAGGTGC 550
ACAGCGGCGTGTGCACCGACCCCCAGCCCCTGAAGGAGCAGCCCGCCCTG 600
AACGACAGCCGCTACTGCCTGAGCAGCCGCCTGCGCGTGAGCGCCACCTT 650
CTGGCAGAACCCCCGCAACCACTTCCGCTGCCAGGTGCAGTTCTACGGCC 700
TGAGCGAGAACGACGAGTGGACCCAGGACCGCGCCAAGCCCGTGACCCAG 750
ATCGTGAGCGCCGAGGCCTGGGGCCGCGCCGACTGCGGCTTCACCAGCGT 800
GAGCTACCAGCAGGGCGTGCTGAGCGCCACCATCCTGTACGAGATCCTGC 850
TGGGCAAGGCCACCCTGTACGCCGTGCTGGTGAGCGCCCTGGTGCTGATG 900
GCCATGGTGAAGCGCAAGGACTTC [SEQ ID NO: 644]

FIG. 83

Donor A5L Clone 6 (FLY)

Alpha chain:
ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCACCGTGGGCAACAGCGGCTA 350
CAGCACCCTGACCTTCGGCAAGGGCACCATGCTGCTGGTGAGCCCCGACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 564]

Beta chain:
ATGAGCATCGGCCTGCTGTGCTGCGCCGCCCTGAGCCTGCTGTGGGCCGG 50
CCCCGTGAACGCCGGCGTGACCCAGACCCCCAAGTTCCAGGTGCTGAAGA 100
CCGGCCAGAGCATGACCCTGCAGTGCGCCCAGGACATGAACCACGAGTAC 150
ATGAGCTGGTACCGCCAGGACCCCGGCATGGGCCTGCGCCTGATCCACTA 200
CAGCGTGGGCGCCGGCATCACCGACCAGGGCGAGGTGCCCAACGGCTACA 250
ACGTGAGCCGCAGCACCACCGAGGACTTCCCCCTGCGCCTGCTGAGCGCC 300
GCCCCCAGCCAGACCAGCGTGTACTTCTGCGCCAGCAGCACCCAGGGCGG 350
CTACCAGCCCCAGCACTTCGGCGACGGCACCCGCCTGAGCATCCTGGAGG 400
ACCTGAACAAGGTGTTCCCCCCCGAGGTGGCCGTGTTCGAGCCCAGCGAG 450
GCCGAGATCAGCCACACCCAGAAGGCCACCCTGGTGTGCCTGGCCACCGG 500
CTTCTTCCCCGACCACGTGGAGCTGAGCTGGTGGGTGAACGGCAAGGAGG 550
TGCACAGCGGCGTGTGCACCGACCCCCAGCCCCTGAAGGAGCAGCCCGCC 600
CTGAACGACAGCCGCTACTGCCTGAGCAGCCGCCTGCGCGTGAGCGCCAC 650
CTTCTGGCAGAACCCCCGCAACCACTTCCGCTGCCAGGTGCAGTTCTACG 700
GCCTGAGCGAGAACGACGAGTGGACCCAGGACCGCGCCAAGCCCGTGACC 750
CAGATCGTGAGCGCCGAGGCCTGGGGCCGCGCCGACTGCGGCTTCACCAG 800
CGTGAGCTACCAGCAGGGCGTGCTGAGCGCCACCATCCTGTACGAGATCC 850
TGCTGGGCAAGGCCACCCTGTACGCCGTGCTGGTGAGCGCCCTGGTGCTG 900
ATGGCCATGGTGAAGCGCAAGGACTTC [SEQ ID NO: 645]

FIG. 84

Donor A5L Clone 7 (FLY)

Alpha chain:

ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCACCGTGGGCGACAGCGGCTA 350
CAGCACCCTGACCTTCGGCAAGGGCACCATGCTGCTGGTGAGCCCCGACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 565]

Beta chain:

ATGAGCATCGGCCTGCTGTGCTGCGCCGCCCTGAGCCTGCTGTGGGCCGG 50
CCCCGTGAACGCCGGCGTGACCCAGACCCCCAAGTTCCAGGTGCTGAAGA 100
CCGGCCAGAGCATGACCCTGCAGTGCGCCCAGGACATGAACCACGAGTAC 150
ATGAGCTGGTACCGCCAGGACCCCGGCATGGGCCTGCGCCTGATCCACTA 200
CAGCGTGGGCGCCGGCATCACCGACCAGGGCGAGGTGCCCAACGGCTACA 250
ACGTGAGCCGCAGCACCACCGAGGACTTCCCCCTGCGCCTGCTGAGCGCC 300
GCCCCCAGCCAGACCAGCGTGTACTTCTGCGCCAGCAGCCGCCAGGGCGG 350
CATCGACGGCTACACCTTCGGCAGCGGCACCCGCCTGACCGTGGTGGAGG 400
ACCTGAACAAGGTGTTCCCCCCCGAGGTGGCCGTGTTCGAGCCCAGCGAG 450
GCCGAGATCAGCCACACCCAGAAGGCCACCCTGGTGTGCCTGGCCACCGG 500
CTTCTTCCCCGACCACGTGGAGCTGAGCTGGTGGGTGAACGGCAAGGAGG 550
TGCACAGCGGCGTGTGCACCGACCCCCAGCCCCTGAAGGAGCAGCCCGCC 600
CTGAACGACAGCCGCTACTGCCTGAGCAGCCGCCTGCGCGTGAGCGCCAC 650
CTTCTGGCAGAACCCCCGCAACCACTTCCGCTGCCAGGTGCAGTTCTACG 700
GCCTGAGCGAGAACGACGAGTGGACCCAGGACCGCGCCAAGCCCGTGACC 750
CAGATCGTGAGCGCCGAGGCCTGGGGCCGCGCCGACTGCGGCTTCACCAG 800
CGTGAGCTACCAGCAGGGCGTGCTGAGCGCCACCATCCTGTACGAGATCC 850
TGCTGGGCAAGGCCACCCTGTACGCCGTGCTGGTGAGCGCCCTGGTGCTG 900
ATGGCCATGGTGAAGCGCAAGGACTTC [SEQ ID NO: 646]

FIG. 85

Donor A5L Clone 8 (FLY)

Alpha chain:

ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCACCGTGGGCAACAGCGGCTA 350
CAGCACCCTGACCTTCGGCAAGGGCACCATGCTGCTGGTGAGCCCCGACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 566]

Beta chain:

ATGAGCATCGGCCTGCTGTGCTGCGCCGCCCTGAGCCTGCTGTGGGCCGG 50
CCCCGTGAACGCCGGCGTGACCCAGACCCCCAAGTTCCAGGTGCTGAAGA 100
CCGGCCAGAGCATGACCCTGCAGTGCGCCCAGGACATGAACCACGAGTAC 150
ATGAGCTGGTACCGCCAGGACCCCGGCATGGGCCTGCGCCTGATCCACTA 200
CAGCGTGGGCGCCGGCATCACCGACCAGGGCGAGGTGCCCAACGGCTACA 250
ACGTGAGCCGCAGCACCACCGAGGACTTCCCCCTGCGCCTGCTGAGCGCC 300
GCCCCCAGCCAGACCAGCGTGTACTTCTGCGCCAGCAGCAAGCAGGGCGG 350
CAACGAGCAGTTCTTCGGCCCCGGCACCCGCCTGACCGTGCTGGAGGACC 400
TGAACAAGGTGTTCCCCCCCGAGGTGGCCGTGTTCGAGCCCAGCGAGGCC 450
GAGATCAGCCACACCCAGAAGGCCACCCTGGTGTGCCTGGCCACCGGCTT 500
CTTCCCCGACCACGTGGAGCTGAGCTGGTGGGTGAACGGCAAGGAGGTGC 550
ACAGCGGCGTGTGCACCGACCCCCAGCCCCTGAAGGAGCAGCCCGCCCTG 600
AACGACAGCCGCTACTGCCTGAGCAGCCGCCTGCGCGTGAGCGCCACCTT 650
CTGGCAGAACCCCCGCAACCACTTCCGCTGCCAGGTGCAGTTCTACGGCC 700
TGAGCGAGAACGACGAGTGGACCCAGGACCGCGCCAAGCCCGTGACCCAG 750
ATCGTGAGCGCCGAGGCCTGGGGCCGCGCCGACTGCGGCTTCACCAGCGT 800
GAGCTACCAGCAGGGCGTGCTGAGCGCCACCATCCTGTACGAGATCCTGC 850
TGGGCAAGGCCACCCTGTACGCCGTGCTGGTGAGCGCCCTGGTGCTGATG 900
GCCATGGTGAAGCGCAAGGACTTC [SEQ ID NO: 647]

FIG. 86

Donor A5L Clone 9 (FLY)

Alpha chain:

ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCACCGTGGGCAACAGCGGCTA 350
CAGCACCCTGACCTTCGGCAAGGGCACCATGCTGCTGGTGAGCCCCGACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 567]

Beta chain:

ATGAGCATCGGCCTGCTGTGCTGCGCCGCCCTGAGCCTGCTGTGGGCCGG 50
CCCCGTGAACGCCGGCGTGACCCAGACCCCCAAGTTCCAGGTGCTGAAGA 100
CCGGCCAGAGCATGACCCTGCAGTGCGCCCAGGACATGAACCACGAGTAC 150
ATGAGCTGGTACCGCCAGGACCCCGGCATGGGCCTGCGCCTGATCCACTA 200
CAGCGTGGGCGCCGGCATCACCGACCAGGGCGAGGTGCCCAACGGCTACA 250
ACGTGAGCCGCAGCACCACCGAGGACTTCCCCCTGCGCCTGCTGAGCGCC 300
GCCCCCAGCCAGACCAGCGTGTACTTCTGCGCCAGCAGCCCCCAGGGCGG 350
CAACGAGCAGTTCTTCGGCCCCGGCACCCGCCTGACCGTGCTGGAGGACC 400
TGAACAAGGTGTTCCCCCCCGAGGTGGCCGTGTTCGAGCCCAGCGAGGCC 450
GAGATCAGCCACACCCAGAAGGCCACCCTGGTGTGCCTGGCCACCGGCTT 500
CTTCCCCGACCACGTGGAGCTGAGCTGGTGGGTGAACGGCAAGGAGGTGC 550
ACAGCGGCGTGTGCACCGACCCCCAGCCCCTGAAGGAGCAGCCCGCCCTG 600
AACGACAGCCGCTACTGCCTGAGCAGCCGCCTGCGCGTGAGCGCCACCTT 650
CTGGCAGAACCCCCGCAACCACTTCCGCTGCCAGGTGCAGTTCTACGGCC 700
TGAGCGAGAACGACGAGTGGACCCAGGACCGCGCCAAGCCCGTGACCCAG 750
ATCGTGAGCGCCGAGGCCTGGGGCCGCGCCGACTGCGGCTTCACCAGCGT 800
GAGCTACCAGCAGGGCGTGCTGAGCGCCACCATCCTGTACGAGATCCTGC 850
TGGGCAAGGCCACCCTGTACGCCGTGCTGGTGAGCGCCCTGGTGCTGATG 900
GCCATGGTGAAGCGCAAGGACTTC [SEQ ID NO: 648]

FIG. 87

Donor T4W Clone 1 (FLY)

Alpha chain:

ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCACCGAGGGCAACAGCGGCTA 350
CAGCACCCTGACCTTCGGCAAGGGCACCATGCTGCTGGTGAGCCCCGACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 568]

Beta chain:

ATGAGCATCGGCCTGCTGTGCTGCGCCGCCCTGAGCCTGCTGTGGGCCGG 50
CCCCGTGAACGCCGGCGTGACCCAGACCCCCAAGTTCCAGGTGCTGAAGA 100
CCGGCCAGAGCATGACCCTGCAGTGCGCCCAGGACATGAACCACGAGTAC 150
ATGAGCTGGTACCGCCAGGACCCCGGCATGGGCCTGCGCCTGATCCACTA 200
CAGCGTGGGCGCCGGCATCACCGACCAGGGCGAGGTGCCCAACGGCTACA 250
ACGTGAGCCGCAGCACCACCGAGGACTTCCCCCTGCGCCTGCTGAGCGCC 300
GCCCCCAGCCAGACCAGCGTGTACTTCTGCGCCAGCAACCGCCAGGGCGG 350
CAACTACGGCTACACCTTCGGCAGCGGCACCCGCCTGACCGTGGTGGAGG 400
ACCTGAACAAGGTGTTCCCCCCCGAGGTGGCCGTGTTCGAGCCCAGCGAG 450
GCCGAGATCAGCCACACCCAGAAGGCCACCCTGGTGTGCCTGGCCACCGG 500
CTTCTTCCCCGACCACGTGGAGCTGAGCTGGTGGGTGAACGGCAAGGAGG 550
TGCACAGCGGCGTGTGCACCGACCCCCAGCCCCTGAAGGAGCAGCCCGCC 600
CTGAACGACAGCCGCTACTGCCTGAGCAGCCGCCTGCGCGTGAGCGCCAC 650
CTTCTGGCAGAACCCCCGCAACCACTTCCGCTGCCAGGTGCAGTTCTACG 700
GCCTGAGCGAGAACGACGAGTGGACCCAGGACCGCGCCAAGCCCGTGACC 750
CAGATCGTGAGCGCCGAGGCCTGGGGCCGCGCCGACTGCGGCTTCACCAG 800
CGTGAGCTACCAGCAGGGCGTGCTGAGCGCCACCATCCTGTACGAGATCC 850
TGCTGGGCAAGGCCACCCTGTACGCCGTGCTGGTGAGCGCCCTGGTGCTG 900
ATGGCCATGGTGAAGCGCAAGGACTTC [SEQ ID NO: 649]

FIG. 88

Donor T4W Clone 2 (FLY)

Alpha chain:

ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCACCGAGGGCGACAGCGGCTA 350
CAGCACCCTGACCTTCGGCAAGGGCACCATGCTGCTGGTGAGCCCCGACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 569]

Beta chain:

ATGAGCATCGGCCTGCTGTGCTGCGCCGCCCTGAGCCTGCTGTGGGCCGG 50
CCCCGTGAACGCCGGCGTGACCCAGACCCCCAAGTTCCAGGTGCTGAAGA 100
CCGGCCAGAGCATGACCCTGCAGTGCGCCCAGGACATGAACCACGAGTAC 150
ATGAGCTGGTACCGCCAGGACCCCGGCATGGGCCTGCGCCTGATCCACTA 200
CAGCGTGGGCGCCGGCATCACCGACCAGGGCGAGGTGCCCAACGGCTACA 250
ACGTGAGCCGCAGCACCACCGAGGACTTCCCCCTGCGCCTGCTGAGCGCC 300
GCCCCCAGCCAGACCAGCGTGTACTTCTGCGCCAGCAGCCGCCAGGGCGG 350
CAACTACGGCTACACCTTCGGCAGCGGCACCCGCCTGACCGTGGTGGAGG 400
ACCTGAACAAGGTGTTCCCCCCCGAGGTGGCCGTGTTCGAGCCCAGCGAG 450
GCCGAGATCAGCCACACCCAGAAGGCCACCCTGGTGTGCCTGGCCACCGG 500
CTTCTTCCCCGACCACGTGGAGCTGAGCTGGTGGGTGAACGGCAAGGAGG 550
TGCACAGCGGCGTGTGCACCGACCCCCAGCCCCTGAAGGAGCAGCCCGCC 600
CTGAACGACAGCCGCTACTGCCTGAGCAGCCGCCTGCGCGTGAGCGCCAC 650
CTTCTGGCAGAACCCCCGCAACCACTTCCGCTGCCAGGTGCAGTTCTACG 700
GCCTGAGCGAGAACGACGAGTGGACCCAGGACCGCGCCAAGCCCGTGACC 750
CAGATCGTGAGCGCCGAGGCCTGGGGCCGCGCCGACTGCGGCTTCACCAG 800
CGTGAGCTACCAGCAGGGCGTGCTGAGCGCCACCATCCTGTACGAGATCC 850
TGCTGGGCAAGGCCACCCTGTACGCCGTGCTGGTGAGCGCCCTGGTGCTG 900
ATGGCCATGGTGAAGCGCAAGGACTTC [SEQ ID NO: 650]

FIG. 89

Donor T4W Clone 3 (FLY)

Alpha chain:
ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCACCGAGGGCAACAGCGGCTA 350
CAGCACCCTGACCTTCGGCAAGGGCACCATGCTGCTGGTGAGCCCCGACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 570]

Beta chain:
ATGAGCATCGGCCTGCTGTGCTGCGCCGCCCTGAGCCTGCTGTGGGCCGG 50
CCCCGTGAACGCCGGCGTGACCCAGACCCCCAAGTTCCAGGTGCTGAAGA 100
CCGGCCAGAGCATGACCCTGCAGTGCGCCCAGGACATGAACCACGAGTAC 150
ATGAGCTGGTACCGCCAGGACCCCGGCATGGGCCTGCGCCTGATCCACTA 200
CAGCGTGGGCGCCGGCATCACCGACCAGGGCGAGGTGCCCAACGGCTACA 250
ACGTGAGCCGCAGCACCACCGAGGACTTCCCCCTGCGCCTGCTGAGCGCC 300
GCCCCCAGCCAGACCAGCGTGTACTTCTGCGCCAGCAGCCAGCAGGGCGG 350
CGACCACTACGGCTACACCTTCGGCAGCGGCACCCGCCTGACCGTGGTGG 400
AGGACCTGAACAAGGTGTTCCCCCCCGAGGTGGCCGTGTTCGAGCCCAGC 450
GAGGCCGAGATCAGCCACACCCAGAAGGCCACCCTGGTGTGCCTGGCCAC 500
CGGCTTCTTCCCCGACCACGTGGAGCTGAGCTGGTGGGTGAACGGCAAGG 550
AGGTGCACAGCGGCGTGTGCACCGACCCCCAGCCCCTGAAGGAGCAGCCC 600
GCCCTGAACGACAGCCGCTACTGCCTGAGCAGCCGCCTGCGCGTGAGCGC 650
CACCTTCTGGCAGAACCCCCGCAACCACTTCCGCTGCCAGGTGCAGTTCT 700
ACGGCCTGAGCGAGAACGACGAGTGGACCCAGGACCGCGCCAAGCCCGTG 750
ACCCAGATCGTGAGCGCCGAGGCCTGGGGCCGCGCCGACTGCGGCTTCAC 800
CAGCGTGAGCTACCAGCAGGGCGTGCTGAGCGCCACCATCCTGTACGAGA 850
TCCTGCTGGGCAAGGCCACCCTGTACGCCGTGCTGGTGAGCGCCCTGGTG 900
CTGATGGCCATGGTGAAGCGCAAGGACTTC [SEQ ID NO: 651]

FIG. 90

Donor T4W Clone 4 (FLY)

Alpha chain:

ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCACCGAGGGCAACAGCGGCTA 350
CAGCACCCTGACCTTCGGCAAGGGCACCATGCTGCTGGTGAGCCCCGACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 571]

Beta chain:

ATGAGCATCGGCCTGCTGTGCTGCGCCGCCCTGAGCCTGCTGTGGGCCGG 50
CCCCGTGAACGCCGGCGTGACCCAGACCCCCAAGTTCCAGGTGCTGAAGA 100
CCGGCCAGAGCATGACCCTGCAGTGCGCCCAGGACATGAACCACGAGTAC 150
ATGAGCTGGTACCGCCAGGACCCCGGCATGGGCCTGCGCCTGATCCACTA 200
CAGCGTGGGCGCCGGCATCACCGACCAGGGCGAGGTGCCCAACGGCTACA 250
ACGTGAGCCGCAGCACCACCGAGGACTTCCCCCTGCGCCTGCTGAGCGCC 300
GCCCCCAGCCAGACCAGCGTGTACTTCTGCGCCAGCAGCCCCCAGGGCGG 350
CAGCCGCGGCTACACCTTCGGCAGCGGCACCCGCCTGACCGTGGTGGAGG 400
ACCTGAACAAGGTGTTCCCCCCCGAGGTGGCCGTGTTCGAGCCCAGCGAG 450
GCCGAGATCAGCCACACCCAGAAGGCCACCCTGGTGTGCCTGGCCACCGG 500
CTTCTTCCCCGACCACGTGGAGCTGAGCTGGTGGGTGAACGGCAAGGAGG 550
TGCACAGCGGCGTGTGCACCGACCCCCAGCCCCTGAAGGAGCAGCCCGCC 600
CTGAACGACAGCCGCTACTGCCTGAGCAGCCGCCTGCGCGTGAGCGCCAC 650
CTTCTGGCAGAACCCCCGCAACCACTTCCGCTGCCAGGTGCAGTTCTACG 700
GCCTGAGCGAGAACGACGAGTGGACCCAGGACCGCGCCAAGCCCGTGACC 750
CAGATCGTGAGCGCCGAGGCCTGGGGCCGCGCCGACTGCGGCTTCACCAG 800
CGTGAGCTACCAGCAGGGCGTGCTGAGCGCCACCATCCTGTACGAGATCC 850
TGCTGGGCAAGGCCACCCTGTACGCCGTGCTGGTGAGCGCCCTGGTGCTG 900
ATGGCCATGGTGAAGCGCAAGGACTTC [SEQ ID NO: 652]

FIG. 91

Donor T4W Clone 5 (FLY)

Alpha chain:

ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCACCGAGGGCGACAGCGGCTA 350
CAGCACCCTGACCTTCGGCAAGGGCACCATGCTGCTGGTGAGCCCCGACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 572]

Beta chain:

ATGAGCATCGGCCTGCTGTGCTGCGCCGCCCTGAGCCTGCTGTGGGCCGG 50
CCCCGTGAACGCCGGCGTGACCCAGACCCCCAAGTTCCAGGTGCTGAAGA 100
CCGGCCAGAGCATGACCCTGCAGTGCGCCCAGGACATGAACCACGAGTAC 150
ATGAGCTGGTACCGCCAGGACCCCGGCATGGGCCTGCGCCTGATCCACTA 200
CAGCGTGGGCGCCGGCATCACCGACCAGGGCGAGGTGCCCAACGGCTACA 250
ACGTGAGCCGCAGCACCACCGAGGACTTCCCCCTGCGCCTGCTGAGCGCC 300
GCCCCCAGCCAGACCAGCGTGTACTTCTGCGCCAGCCGCCTGCAGGGCGG 350
CTTCAACGGCTACACCTTCGGCAGCGGCACCCGCCTGACCGTGGTGGAGG 400
ACCTGAACAAGGTGTTCCCCCCCGAGGTGGCCGTGTTCGAGCCCAGCGAG 450
GCCGAGATCAGCCACACCCAGAAGGCCACCCTGGTGTGCCTGGCCACCGG 500
CTTCTTCCCCGACCACGTGGAGCTGAGCTGGTGGGTGAACGGCAAGGAGG 550
TGCACAGCGGCGTGTGCACCGACCCCCAGCCCCTGAAGGAGCAGCCCGCC 600
CTGAACGACAGCCGCTACTGCCTGAGCAGCCGCCTGCGCGTGAGCGCCAC 650
CTTCTGGCAGAACCCCCGCAACCACTTCCGCTGCCAGGTGCAGTTCTACG 700
GCCTGAGCGAGAACGACGAGTGGACCCAGGACCGCGCCAAGCCCGTGACC 750
CAGATCGTGAGCGCCGAGGCCTGGGGCCGCGCCGACTGCGGCTTCACCAG 800
CGTGAGCTACCAGCAGGGCGTGCTGAGCGCCACCATCCTGTACGAGATCC 850
TGCTGGGCAAGGCCACCCTGTACGCCGTGCTGGTGAGCGCCCTGGTGCTG 900
ATGGCCATGGTGAAGCGCAAGGACTTC [SEQ ID NO: 653]

FIG. 92

Donor T4W Clone 6 (FLY)

Alpha chain:

ATGGAGACCCTGCTGGGCGTGAGCCTGGTGATCCTGTGGCTGCAGCTGGC 50
CCGCGTGAACAGCCAGCAGGGCGAGGAGGACCCCCAGGCCCTGAGCATCC 100
AGGAGGGCGAGAACGCCACCATGAACTGCAGCTACAAGACCAGCATCAAC 150
AACCTGCAGTGGTACCGCCAGAACAGCGGCCGCGGCCTGGTGCACCTGAT 200
CCTGATCCGCAGCAACGAGCGCGAGAAGCACAGCGGCCGCCTGCGCGTGA 250
CCCTGGACACCAGCAAGAAGAGCAGCAGCCTGCTGATCACCGCCAGCCGC 300
GCCGCCGACACCGCCAGCTACTTCTGCGCCACCGTGGGCGACAGCGGCTA 350
CAGCACCCTGACCTTCGGCAAGGGCACCATGCTGCTGGTGAGCCCCGACA 400
TCCAGAACCCCGACCCCGCCGTGTACCAGCTGCGCGACAGCAAGAGCAGC 450
GACAAGAGCGTGTGCCTGTTCACCGACTTCGACAGCCAGACCAACGTGAG 500
CCAGAGCAAGGACAGCGACGTGTACATCACCGACAAGTGCGTGCTGGACA 550
TGCGCAGCATGGACTTCAAGAGCAACAGCGCCGTGGCCTGGAGCAACAAG 600
AGCGACTTCGCCTGCGCCAACGCCTTCAACAACAGCATCATCCCCGAGGA 650
CACCTTCTTCCCCAGCCCCGAGAGCAGCTGCGACGTGAAGCTGGTGGAGA 700
AGAGCTTCGAGACCGACACCAACCTGAACTTCCAGAACCTGAGCGTGATC 750
GGCTTCCGCATCCTGCTGCTGAAGGTGGCCGGCTTCAACCTGCTGATGAC 800
CCTGCGCCTGTGGAGCAGC [SEQ ID NO: 573]

Beta chain:

ATGAGCATCGGCCTGCTGTGCTGCGCCGCCCTGAGCCTGCTGTGGGCCGG 50
CCCCGTGAACGCCGGCGTGACCCAGACCCCCAAGTTCCAGGTGCTGAAGA 100
CCGGCCAGAGCATGACCCTGCAGTGCGCCCAGGACATGAACCACGAGTAC 150
ATGAGCTGGTACCGCCAGGACCCCGGCATGGGCCTGCGCCTGATCCACTA 200
CAGCGTGGGCGCCGGCATCACCGACCAGGGCGAGGTGCCCAACGGCTACA 250
ACGTGAGCCGCAGCACCACCGAGGACTTCCCCCTGCGCCTGCTGAGCGCC 300
GCCCCCAGCCAGACCAGCGTGTACTTCTGCGCCAGCAGCGTGCAGGGCGG 350
CGCCCACGAGCAGTACTTCGGCCCCGGCACCCGCCTGACCGTGACCGAGG 400
ACCTGAACAAGGTGTTCCCCCCCGAGGTGGCCGTGTTCGAGCCCAGCGAG 450
GCCGAGATCAGCCACACCCAGAAGGCCACCCTGGTGTGCCTGGCCACCGG 500
CTTCTTCCCCGACCACGTGGAGCTGAGCTGGTGGGTGAACGGCAAGGAGG 550
TGCACAGCGGCGTGTGCACCGACCCCCAGCCCCTGAAGGAGCAGCCCGCC 600
CTGAACGACAGCCGCTACTGCCTGAGCAGCCGCCTGCGCGTGAGCGCCAC 650
CTTCTGGCAGAACCCCCGCAACCACTTCCGCTGCCAGGTGCAGTTCTACG 700
GCCTGAGCGAGAACGACGAGTGGACCCAGGACCGCGCCAAGCCCGTGACC 750
CAGATCGTGAGCGCCGAGGCCTGGGGCCGCGCCGACTGCGGCTTCACCAG 800
CGTGAGCTACCAGCAGGGCGTGCTGAGCGCCACCATCCTGTACGAGATCC 850
TGCTGGGCAAGGCCACCCTGTACGCCGTGCTGGTGAGCGCCCTGGTGCTG 900
ATGGCCATGGTGAAGCGCAAGGACTTC [SEQ ID NO: 654]

FIG. 93

**TCRs specific for HLA-B*40:01-IEDPPFNSL**

Donor N3M Clone 1 (IED)

Alpha chain:
METLLGLLILWLQLQWVSSKQEVTQIPAALSVPEGENLVLNCSFTDSAIYNLQWFRQDPG
KGLTSLLLIQSSQREQTSGRLNASLDKSSGRSTLYIAASQPGDSATYLCAVYSGAGSYQLTFGKGTKLSVIP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 655]

Beta chain:
MGPQLLGYVVLCLLGAGPLEAQVTQNPRYLITVTGKKLTVTCSQNMNHEYMSWYRQDPGL
GLRQIYYSMNVEVTDKGDVPEGYKVSRKEKRNFPLILESPSPNQTSLYFCASRTGGVNEQYFGPGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 736]

Donor B24 Clone 1 (IED)

Alpha chain:
MWGVFLLYVSMKMGGTTGQNIDQPTEMTATEGAIVQINCTYQTSGFNGLFWYQQHAGEAP
TFLSYNVLDGLEEKGRFSSFLSRSKGYSYLLLKELQMKDSASYLCAVGGNTGGFKTIFGAGTRLFVKA
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 656]

Beta chain:
MGFRLLCCVAFCLLGAGPVDSGVTQTPKHLITATGQRVTLRCSPRSGDLSVYWYQQSLDQ
GLQFLIQYYNGEERAKGNILERFSAQQFPDLHSELNLSSLELGDSALYFCASSAGQGLAGDEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 737]

Donor B24 Clone 2 (IED)

Alpha chain:
MLTASLLRAVIASICVVSSMAQKVTQAQTEISVVEKEDVTLDCVYETRDTTYYLFWYKQP
PSGELVFLIRRNSFDEQNEISGRYSWNFQKSTSSFNFTITASQVVDSAVYFCALSEARGSQGNLIFGKGTKLSVKP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 657]

Beta chain:
MGCRLLCCAVLCLLGAVPIDTEVTQTPKHLVMGMTNKKSLKCEQHMGHRAMYWYKQKAKK
PPELMFVYSYEKLSINESVPSRFSPECPNSSLLNLHLHALQPEDSALYLCASSQEAASGGLINEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 738]

FIG. 94

Donor B24 Clone 3 (IED)
Alpha chain:
MKLVTSITVLLSLGIMGDAKTTQPNSMESNEEEPVHLPCNHSTISGTDYIHWYRQLPSQG
PEYVIHGLTSNVNNRMASLAIAEDRKSSTLILHRATLRDAAVYYCILRDVTGGFKTIFGAGTRLFVKA
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 658]
Beta chain:
MGPQLLGYVVLCLLGAGPLEAQVTQNPRYLITVTGKKLTVTCSQNMNHEYMSWYRQDPGL
GLRQIYYSMNVEVTDKGDVPEGYKVSRKEKRNFPLILESPSPNQTSLYFCASSYSGGPLYEQYFGPGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 739]

Donor B24 Clone 4 (IED)
Alpha chain:
MLLEHLLIILWMQLTWVSGQQLNQSPQSMFIQEGEDVSMNCTSSSIFNTWLWYKQDPGEG
PVLLIALYKAGELTSNGRLTAQFGITRKDSFLNISASIPSDVGIYFCAGRGSYNFNKFYFGSGTKLNVKP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 659]
Beta chain:
MGPQLLGYVVLCLLGAGPLEAQVTQNPRYLITVTGKKLTVTCSQNMNHEYMSWYRQDPGL
GLRQIYYSMNVEVTDKGDVPEGYKVSRKEKRNFPLILESPSPNQTSLYFCASSYAGGPQYGYTFGSGTRLTVV
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 740]

Donor A5L Clone 1 (IED)
Alpha chain:
MWGAFLLYVSMKMGGTAGQSLEQPSEVTAVEGAIVQINCTYQTSGFYGLSWYQQHDGGAP
TFLSYNALDGLEETGRFSSFLSRSDSYGYLLLQELQMKDSASYFCASSEGKLIFGQGTELSVKP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 660]
Beta chain:
MLLLLLLLGPGISLLLPGSLAGSGLGAVVSQHPSWVICKSGTSVKIECRSLDFQATTMFWYRQFPKQSLM
LMATSNEGSKATYEQGVEKDKFLINHASLTLSTLTVTSAHPEDSSFYICSARDGSPIAGGLNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 741]

FIG. 94 cont'd

Donor A5L Clone 2 (IED)
Alpha chain:
MKPTLISVLVIIFILRGTRAQRVTQPEKLLSVFKGAPVELKCNYSYSGSPELFWYVQYSR
QRLQLLLRHISRESIKGFTADLNKGETSFHLKKPFAQEEDSAMYYCALRWQTGANNLFFGTGTRLTVIP
YIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 661]
Beta chain:
MGPQLLGYVVLCLLGAGPLEAQVTQNPRYLITVTGKKLTVTCSQNMNHEYMSWYRQDPGL
GLRQIYYSMNVEVTDKGDVPEGYKVSRKEKRNFPLILESPSPNQTSLYFCASSYSGGPLYEQYFGPGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 742]

Donor A5L Clone 3 (IED)
Alpha chain:
MWGVFLLYVSMKMGGTTGQNIDQPTEMTATEGAIVQINCTYQTSGFNGLFWYQQHAGEAP
TFLSYNVLDGLEEKGRFSSFLSRSKGYSYLLLKELQMKDSASYLCAVNGGTGGFKTIFGAGTRLFVKA
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 662]
Beta chain:
MGFRLLCCVAFCLLGAGPVDSGVTQTPKHLITATGQRVTLRCSPRSGDLSVYWYQQSLDQ
GLQFLIQYYNGEERAKGNILERFSAQQFPDLHSELNLSSLELGDSALYFCASSVGEGLAGDTQYFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 743]

Donor A5L Clone 4 (IED)
Alpha chain:
MEKNPLAAPLLILWFHLDCVSSILNVEQSPQSLHVQEGDSTNFTCSFPSSNFYALHWYRW
ETAKSPEALFVMTLNGDEKKKGRISATLNTKEGYSYLYIKGSQPEDSATYLCASPRTGFQKLVFGTGTRLLVSP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 663]
Beta chain:
MGPQLLGYVVLCLLGAGPLEAQVTQNPRYLITVTGKKLTVTCSQNMNHEYMSWYRQDPGL
GLRQIYYSMNVEVTDKGDVPEGYKVSRKEKRNFPLILESPSPNQTSLYFCASRYSGGPLYEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 744]

FIG. 94 cont'd

Donor A5L Clone 5 (IED)
Alpha chain:
MWGAFLLYVSMKMGGTAGQSLEQPSEVTAVEGAIVQINCTYQTSGFYGLSWYQQHDGGAP
TFLSYNALDGLEETGRFSSFLSRSDSYGYLLLQELQMKDSASYFCASTEGKLIFGQGTELSVKP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 664]
Beta chain:
MLLLLLLLGPGISLLLPGSLAGSGLGAVVSQHPSWVICKSGTSVKIECRSLDFQATTMFWYRQFPKQSLM
LMATSNEGSKATYEQGVEKDKFLINHASLTLSTLTVTSAHPEDSSFYICSARDGSPIAGGLNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 745]

Donor B31 Clone 1 (IED)
Alpha chain:
MTRVSLLWAVVVSTCLESGMAQTVTQSQPEMSVQEAETVTLSCTYDTSENNYYLFWYKQP
PSRQMILVIRQEAYKQQNATENRFSVNFQKAAKSFSLKISDSQLGDTAMYFCAFMTVYNQGGKLIFGQGTELSVKP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 665]
Beta chain:
MGCRLLCCAVLCLLGAVPIDTEVTQTPKHLVMGMTNKKSLKCEQHMGHRAMYWYKQKAKK
PPELMFVYSYEKLSINESVPSRFSPECPNSSLLNLHLHALQPEDSALYLCASSQEAGRQNTQYFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 746]

Donor B31 Clone 2 (IED)
Alpha chain:
METLLGLLILWLQLQWVSSKQEVTQIPAALSVPEGENLVLNCSFTDSAIYNLQWFRQDPG
KGLTSLLLIQSSQREQTSGRLNASLDKSSGRSTLYIAASQPGDSATYLCAPYSGAGAYQLTFGKGTKLSVIP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 666]
Beta chain:
MGPQLLGYVVLCLLGAGPLEAQVTQNPRYLITVTGKKLTVTCSQNMNHEYMSWYRQDPGL
GLRQIYYSMNVEVTDKGDVPEGYKVSRKEKRNFPLILESPSPNQTSLYFCATRTGAVNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 747]

FIG. 94 cont'd

TCRs specific for HLA-A*11:01-SSCSSCPLSK

Donor R7Z Clone 1 (SSC)

Alpha chain:

METLLGLLILWLQLQWVSSKQEVTQIPAALSVPEGENLVLNCSFTDSAIYNLQWFRQDPG
KGLTSLLLIQSSQREQTSGRLNASLDKSSGRSTLYIAASQPGDSATYLCAVWAGGTSYGKLTFGQGTILTVHP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 667]

Beta chain:

MGIRLLCRVAFCFLAVGLVDVKVTQSSRYLVKRTGEKVFLECVQDMDHENMFWYRQDPGL
GLRLIYFSYDVKMKEKGDIPEGYSVSREKKERFSLILESASTNQTSMYLCASSPAGRPGKPLHFGNGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 748]

Donor R7Z Clone 2 (SSC)

Alpha chain:

MKRILGALLGLLSAQVCCVRGIQVEQSPPDLILQEGANSTLRCNFSDSVNNLQWFHQNPW
GQLINLFYIPSGTKQNGRLSATTVATERYSLLYISSSQTTDSGVYFCAVVINNDMRFGAGTRLTVKP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 668]

Beta chain:

MGFRLLCCVAFCLLGAGPVDSGVTQTPKHLITATGQRVTLRCSPRSGDLSVYWYQQSLDQ
GLQFLIQYYNGEERAKGNILERFSAQQFPDLHSELNLSSLELGDSALYFCASSVAPFYEQYFGPGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 749]

Donor R7Z Clone 3 (SSC)

Alpha chain:

MASAPISMLAMLFTLSGLRAQSVAQPEDQVNVAEGNPLTVKCTYSVSGNPYLFWYVQYPN
RGLQFLLKYITGDNLVKGSYGFEAEFNKSQTSFHLKKPSALVSDSALYFCAVREASGANNLFFGTGTRLTVIP
YIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 669]

Beta chain:

MLCSLLALLLGTFFGVRSQTIHQWPATLVQPVGSPLSLECTVEGTSNPNLYWYRQAAGRG
LQLLFYSVGIGQISSEVPQNLSASRPQDRQFILSSKKLLLSDSGFYLCAWSPQGNSPLHFGNGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 750]

FIG. 95

Donor R7Z Clone 4 (SSC)
Alpha chain:
MLLLLVPVLEVIFTLGGTRAQSVTQLDSHVSVSEGTPVLLRCNYSSSYSPSLFWYVQHPN
KGLQLLLKYTSAATLVKGINGFEAEFKKSETSFHLTKPSAHMSDAAEYFCVVSYLGDTGRRALTFGSGTRLQVQP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 670]
Beta chain:
MDTWLVCWAIFSLLKAGLTEPEVTQTPSHQVTQMGQEVILRCVPISNHLYFYWYRQILGQ
KVEFLVSFYNNEISEKSEIFDDQFSVERPDGSNFTLKIRSTKLEDSAMYFCASSESGSPTGELFFGEGSRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 751]

Donor R7Z Clone 5 (SSC)
Alpha chain:
MKRILGALLGLLSAQVCCVRGIQVEQSPPDLILQEGANSTLRCNFSDSVNNLQWFHQNPW
GQLINLFYIPSGTKQNGRLSATTVATERYSLLYISSSQTTDSGVYFCAVVGNNDMRFGAGTRLTVKP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 671]
Beta chain:
MGFRLLCCVAFCLLGAGPVDSGVTQTPKHLITATGQRVTLRCSPRSGDLSVYWYQQSLDQ
GLQFLIQYYNGEERAKGNILERFSAQQFPDLHSELNLSSLELGDSALYFCASSVAPWYEQYFGPGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 752]

Donor B5F Clone 1 (SSC)
Alpha chain:
MKRILGALLGLLSAQVCCVRGIQVEQSPPDLILQEGANSTLRCNFSDSVNNLQWFHQNPW
GQLINLFYIPSGTKQNGRLSATTVATERYSLLYISSSQTTDSGVYFCAVLNNNDMRFGAGTRLTVKP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 672]
Beta chain:
MGFRLLCCVAFCLLGAGPVDSGVTQTPKHLITATGQRVTLRCSPRSGDLSVYWYQQSLDQ
GLQFLIQYYNGEERAKGNILERFSAQQFPDLHSELNLSSLELGDSALYFCASSVSSWYEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 753]

FIG. 95 cont'd

Donor B5F Clone 2 (SSC)
Alpha chain:
MAGIRALFMYLWLQLDWVSRGESVGLHLPTLSVQEGDNSIINCAYSNSASDYFIWYKQES
GKGPQFIIDIRSNMDKRQGQRVTVLLNKTVKHLSLQIAATQPGDSAVYFCAETPGGYQKVTFGTGTKLQVIP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 673]
Beta chain:
MGPQLLGYVVLCLLGAGPLEAQVTQNPRYLITVTGKKLTVTCSQNMNHEYMSWYRQDPGL
GLRQIYYSMNVEVTDKGDVPEGYKVSRKEKRNFPLILESPSPNQTSLYFCASSLWTSNSPLHFGNGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 754]

Donor T3V Clone 1 (SSC)
Alpha chain:
MAMLLGASVLILWLQPDWVNSQQKNDDQQVKQNSPSLSVQEGRISILNCDYTNSMFDYFL
WYKKYPAEGPTFLISISSIKDKNEDGRFTVFLNKSAKHLSLHIVPSQPGDSAVYFCAASAGGQNFVFGPGTRLSVLP
YIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 674]
Beta chain:
MGTRLFFYVALCLLWTGHMDAGITQSPRHKVTETGTPVTLRCHQTENHRYMYWYRQDPGH
GLRLIHYSYGVKDTDKGEVSDGYSVSRSKTEDFLLTLESATSSQTSVYFCAIRRGGSSYNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 755]

Donor T3V Clone 2 (SSC)
Alpha chain:
MWGVFLLYVSMKMGGTTGQNIDQPTEMTATEGAIVQINCTYQTSGFNGLFWYQQHAGEAP
TFLSYNVLDGLEEKGRFSSFLSRSKGYSYLLLKELQMKDSASYLCAVKDSNYQLIWGAGTKLIIKP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 675]
Beta chain:
MRIRLLCCVAFSLLWAGPVIAGITQAPTSQILAAGRRMTLRCTQDMRHNAMYWYRQDLGL
GLRLIHYSNTAGTTGKGEVPDGYSVSRANTDDFPLTLASAVPSQTSVYFCASSADQGDGTDTQYFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 756]

FIG. 95 cont'd

Donor T3V Clone 3 (SSC)
Alpha chain:
MWGAFLLYVSMKMGGTAGQSLEQPSEVTAVEGAIVQINCTYQTSGFYGLSWYQQHDGGAP
TFLSYNALDGLEETGRFSSFLSRSDSYGYLLLQELQMKDSASYFCAVPRRNNNARLMFGDGTQLVVKP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 676]
Beta chain:
MGPQLLGYVVLCLLGAGPLEAQVTQNPRYLITVTGKKLTVTCSQNMNHEYMSWYRQDPGL
GLRQIYYSMNVEVTDKGDVPEGYKVSRKEKRNFPLILESPSPNQTSLYFCASSLNTGMNTEAFFGQGTRLTVV
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 757]

Donor P6G Clone 1 (SSC)
Alpha chain:
METLLGLLILWLQLQWVSSKQEVTQIPAALSVPEGENLVLNCSFTDSAIYNLQWFRQDPG
KGLTSLLLIQSSQREQTSGRLNASLDKSSGRSTLYIAASQPGDSATYLCAVGGDDSGAGSYQLTFGKGTKLSVIPNIQ
NPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 677]
Beta chain:
MGFRLLCCVAFCLLGAGPVDSGVTQTPKHLITATGQRVTLRCSPRSGDLSVYWYQQSLDQ
GLQFLIQYYNGEERAKGNILERFSAQQFPDLHSELNLSSLELGDSALYFCASSRPEGIYNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 758]

Donor P6G Clone 2 (SSC)
Alpha chain:
MLLITSMLVLWMQLSQVNGQQVMQIPQYQHVQEGEDFTTYCNSSTTLSNIQWYKQRPGGH
PVFLIQLVKSGEVKKQKRLTFQFGEAKKNSSLHITATQTTDVGTYFCAGPGIYNQGGKLIFGQGTELSVKP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 678]
Beta chain:
MSNQVLCCVVLCFLGANTVDGGITQSPKYLFRKEGQNVTLSCEQNLNHDAMYWYRQDPGQ
GLRLIYYSQIVNDFQKGDIAEGYSVSREKKESFPLTVTSAQKNPTAFYLCASSPGLADYEQYFGPGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 759]

FIG. 95 cont'd

Donor P6G Clone 3 (SSC)
Alpha chain:
MSLSSLLKVVTASLWLGPGIAQKITQTQPGMFVQEKEAVTLDCTYDTSDPSYGLFWYKQPSSGE
MIFLIYQGSYDQQNATEGRYSLNFQKARKSANLVISASQLGDSAMYFCAMSSSNAGGTSYGKLTFGQGTILTVHP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 679]
Beta chain:
MLCSLLALLLGTFFGVRSQTIHQWPATLVQPVGSPLSLECTVEGTSNPNLYWYRQAAGRG
LQLLFYSVGIGQISSEVPQNLSASRPQDRQFILSSKKLLLSDSGFYLCAWRLEQGLNYEQYFGPGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 760]

Donor A4T Clone 1 (SSC)
Alpha chain:
MAMLLGASVLILWLQPDWVNSQQKNDDQQVKQNSPSLSVQEGRISILNCDYTNSMFDYFLW
YKKYPAEGPTFLISISSIKDKNEDGRFTVFLNKSAKHLSLHIVPSQPGDSAVYFCAASGLVEGNTPLVFGKGTRLSVIA
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 680]
Beta chain:
MGTRLLCWAALCLLGAELTEAGVAQSPRYKIIEKRQSVAFWCNPISGHATLYWYQQILGQ
GPKLLIQFQNNGVVDDSQLPKDRFSAERLKGVDSTLKIQPAKLEDSAVYLCASSLFPGTGIHEQYFGPGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 761]

FIG. 95 cont'd

**TCRs specific for HLA-A*24:02-TYGPVFMSL**

Donor D2M Clone 1 (TYG)

Alpha chain:

METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATDGPYGNNRLAFGKGNQVVVIP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 681]

Beta chain:

MTIRLLCYMGFYFLGAGLMEADIYQTPRYLVIGTGKKITLECSQTMGHDKMYWYQQDPGM
ELHLIHYSYGVNSTEKGDLSSESTVSRIRTEHFPLTLESARPSHTSQYLCASSPLGRSSSYNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 762]

Donor D2M Clone 2 (TYG)

Alpha chain:

METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATDGPYGNNRLAFGKGNQVVVIP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 682]

Beta chain:

MTIRLLCYMGFYFLGAGLMEADIYQTPRYLVIGTGKKITLECSQTMGHDKMYWYQQDPGM
ELHLIHYSYGVNSTEKGDLSSESTVSRIRTEHFPLTLESARPSHTSQYLCASSALGQSSSYNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 763]

Donor D2M Clone 3 (TYG)

Alpha chain:

METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATDGRHGNNRLAFGKGNQVVVIP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 683]

Beta chain:

MTIRLLCYMGFYFLGAGLMEADIYQTPRYLVIGTGKKITLECSQTMGHDKMYWYQQDPGM
ELHLIHYSYGVNSTEKGDLSSESTVSRIRTEHFPLTLESARPSHTSQYLCASSDLGRGSAVNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 764]

FIG. 96

Donor B31 Clone 1 (TYG)
Alpha chain:
MLLITSMLVLWMQLSQVNGQQVMQIPQYQHVQEGEDFTTYCNSSTTLSNIQWYKQRPGGH
PVFLIQLVKSGEVKKQKRLTFQFGEAKKNSSLHITATQTTDVGTYFCAGERGSTLGRLYFGRGTQLTVWP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 684]
Beta chain:
MGTSLLCWMALCLLGADHADTGVSQNPRHKITKRGQNVTFRCDPISEHNRLYWYRQTLGQ
GPEFLTYFQNEAQLEKSRLLSDRFSAERPKGSFSTLEIQRTEQGDSAMYLCASSPLDRGTYEQYFGPGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 765]

Donor B31 Clone 2 (TYG)
Alpha chain:
MLLITSMLVLWMQLSQVNGQQVMQIPQYQHVQEGEDFTTYCNSSTTLSNIQWYKQRPGGH
PVFLIQLVKSGEVKKQKRLTFQFGEAKKNSSLHITATQTTDVGTYFCAGERGSTLGRLYFGRGTQLTVWP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 685]
Beta chain:
MGTSLLCWMALCLLGADHADTGVSQNPRHKITKRGQNVTFRCDPISEHNRLYWYRQTLGQ
GPEFLTYFQNEAQLEKSRLLSDRFSAERPKGSFSTLEIQRTEQGDSAMYLCASSPLERGTYEQYFGPGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 766]

Donor B31 Clone 3 (TYG)
Alpha chain:
MLLITSMLVLWMQLSQVNGQQVMQIPQYQHVQEGEDFTTYCNSSTTLSNIQWYKQRPGGH
PVFLIQLVKSGEVKKQKRLTFQFGEAKKNSSLHITATQTTDVGTYFCAGERGSTLGRLYFGRGTQLTVWP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO:686]
Beta chain:
MGTSLLCWMALCLLGADHADTGVSQNPRHKITKRGQNVTFRCDPISEHNRLYWYRQTLGQ
GPEFLTYFQNEAQLEKSRLLSDRFSAERPKGSFSTLEIQRTEQGDSAMYLCASSLLSSGDYEQYFGPGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 767]

FIG. 96 cont'd

Donor B31 Clone 4 (TYG)

Alpha chain:

MTSIRAVFIFLWLQLDLVNGENVEQHPSTLSVQEGDSAVIKCTYSDSASNYFPWYKQELG
KRPQLIIDIRSNVGEKKDQRIAVTLNKTAKHFSLHITETQPEDSAVYFCAAPRGAAGNKLTFGGGTRVLVKP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 687]

Beta chain:

MSNQVLCCVVLCFLGANTVDGGITQSPKYLFRKEGQNVTLSCEQNLNHDAMYWYRQDPGQ
GLRLIYYSQIVNDFQKGDIAEGYSVSREKKESFPLTVTSAQKNPTAFYLCASSKGASGMRTEQYFGPGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 768]

Donor B31 Clone 5 (TYG)

Alpha chain:

MLLITSMLVLWMQLSQVNGQQVMQIPQYQHVQEGEDFTTYCNSSTTLSNIQWYKQRPGGH
PVFLIQLVKSGEVKKQKRLTFQFGEAKKNSSLHITATQTTDVGTYFCAGERGSTLGRLYFGRGTQLTVWP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 688]

Beta chain:

MASLLFFCGAFYLLGTGSMDADVTQTPRNRITKTGKRIMLECSQTKGHDRMYWYRQDPGL
GLRLIYYSFDVKDINKGEISDGYSVSRQAQAKFSLSLESAIPNQTALYFCATSDTTSTRPTEQYVGPGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 769]

Donor B31 Clone 6 (TYG)

Alpha chain:

METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCAALQGAQKLVFGQGTRLTINP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 689]

Beta chain:

MDTWLVCWAIFSLLKAGLTEPEVTQTPSHQVTQMGQEVILRCVPISNHLYFYWYRQILGQ
KVEFLVSFYNNEISEKSEIFDDQFSVERPDGSNFTLKIRSTKLEDSAMYFCASSATSGSYNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 770]

FIG. 96 cont'd

Donor Y6W Clone 1 (TYG)
Alpha chain:
MRQVARVIVFLTLSTLSLAKTTQPISMDSYEGQEVNITCSHNNIATNDYITWYQQFPSQG
PRFIIQGYKTKVTNEVASLFIPADRKSSTLSLPRVSLSDTAVYYCLVVPFGGYNKLIFGAGTRLAVHP
YIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 690]
Beta chain:
MLSLLLLLLGLGSVFSAVISQKPSRDICQRGTSLTIQCQVDSQVTMMFWYRQQPGQSLTL
IATANQGSEATYESGFVIDKFPISRPNLTFSTLTVSNMSPEDSSIYLCSVGEGTSGYESYNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 771]

Donor Y6W Clone 2 (TYG)
Alpha chain:
MLLITSMLVLWMQLSQVNGQQVMQIPQYQHVQEGEDFTTYCNSSTTLSNIQWYKQRPGGH
PVFLIQLVKSGEVKKQKRLTFQFGEAKKNSSLHITATQTTDVGTYFCAGERGSTLGRLYFGRGTQLTVWP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 691]
Beta chain:
MGTSLLCWMALCLLGADHADTGVSQNPRHKITKRGQNVTFRCDPISEHNRLYWYRQTLGQ
GPEFLTYFQNEAQLEKSRLLSDRFSAERPKGSFSTLEIQRTEQGDSAMYLCASSSLDRGDYEQYFGPGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 772]

Donor Y6W Clone 3 (TYG)
Alpha chain:
METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCAPDRPDTDKLIFGTGTRLQVFP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 692]
Beta chain:
MGTSLLCWMALCLLGADHADTGVSQNPRHKITKRGQNVTFRCDPISEHNRLYWYRQTLGQ
GPEFLTYFQNEAQLEKSRLLSDRFSAERPKGSFSTLEIQRTEQGDSAMYLCASQNRREGRSEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 773]

FIG. 96 cont'd

TCRs specific for HLA-A*24:02-PYLFWLAAI

Donor B33 Clone 1 (PYL)

Alpha chain:

MLLITSMLVLWMQLSQVNGQQVMQIPQYQHVQEGEDFTTYCNSSTTLSNIQWYKQRPGGH
PVFLIQLVKSGEVKKQKRLTFQFGEAKKNSSLHITATQTTDVGTYFCAGPGTGAGSYQLTFGKGTKLSVIP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 693]

Beta chain:

MGIRLLCRVAFCFLAVGLVDVKVTQSSRYLVKRTGEKVFLECVQDMDHENMFWYRQDPGL
GLRLIYFSYDVKMKEKGDIPEGYSVSREKKERFSLILESASTNQTSMYLCASIKSSGYNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 774]

Donor B5F Clone 1 (PYL)

Alpha chain:

MLLITSMLVLWMQLSQVNGQQVMQIPQYQHVQEGEDFTTYCNSSTTLSNIQWYKQRPGGH
PVFLIQLVKSGEVKKQKRLTFQFGEAKKNSSLHITATQTTDVGTYFCAGPYSGAGSYQLTFGKGTKLSVIP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 694]

Beta chain:

MGIRLLCRVAFCFLAVGLVDVKVTQSSRYLVKRTGEKVFLECVQDMDHENMFWYRQDPGL
GLRLIYFSYDVKMKEKGDIPEGYSVSREKKERFSLILESASTNQTSMYLCASILSSGYNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 775]

Donor Y6W Clone 1 (PYL)

Alpha chain:

MRQVARVIVFLTLSTLSLAKTTQPISMDSYEGQEVNITCSHNNIATNDYITWYQQFPSQG
PRFIIQGYKTKVTNEVASLFIPADRKSSTLSLPRVSLSDTAVYYCLVVPFGGYNKLIFGAGTRLAVHPYIQNPDPAVYQ
LRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 695]

Beta chain:

MLSLLLLLLGLGSVFSAVISQKPSRDICQRGTSLTIQCQVDSQVTMMFWYRQQPGQSLTL
IATANQGSEATYESGFVIDKFPISRPNLTFSTLTVSNMSPEDSSIYLCSVGEGTSGYESYNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 776]

FIG. 97

Donor Y6W Clone 2 (PYL)
Alpha chain:
MKSLRVLLVILWLQLSWVWSQQKEVEQNSGPLSVPEGAIASLNCTYSDRGSQSFFWYRQY
SGKSPELIMFIYSNGDKEDGRFTAQLNKASQYVSLLIRDSQPSDSATYLCAVNVGNTGFQKLVFGTGTRLLVSP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 696]
Beta chain:
MLCSLLALLLGTFFGVRSQTIHQWPATLVQPVGSPLSLECTVEGTSNPNLYWYRQAAGRG
LQLLFYSVGIGQISSEVPQNLSASRPQDRQFILSSKKLLLSDSGFYLCACQWQGLGGELFFGEGSRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 777]

Donor Y6W Clone 3 (PYL)
Alpha chain:
MTSIRAVFIFLWLQLDLVNGENVEQHPSTLSVQEGDSAVIKCTYSDSASNYFPWYKQELG
KGPQLIIDIRSNVGEKKDQRIAVTLNKTAKHFSLHITETQPEDSAVYFCAASEFQFYFGTGTSLTVIP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO:697]
Beta chain:
MGFRLLCCVAFCLLGAGPVDSGVTQTPKHLITATGQRVTLRCSPRSGDLSVYWYQQSLDQ
GLQFLIQYYNGEERAKGNILERFSAQQFPDLHSELNLSSLELGDSALYFCASSPGQRANTGELFFGEGSRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 778]

Donor Y6W Clone 4 (PYL)
Alpha chain:
MSLSSLLKVVTASLWLGPGIAQKITQTQPGMFVQEKEAVTLDCTYDTSDPSYGLFWYKQP
SSGEMIFLIYQGSYDQQNATEGRYSLNFQKARKSANLVISASQLGDSAMYFCAMREGVDYQLIWGAGTKLIIKP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 698]
Beta chain:
MGTRLFFYVALCLLWAGHRDAGITQSPRYKITETGRQVTLMCHQTWSHSYMFWYRQDLGH
GLRLIYYSAAADITDKGEVPDGYVVSRSKTENFPLTLESATRSQTSVYFCASSYENEKLFFGSGTQLSVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 779]

FIG. 97 cont'd

Donor Y6W Clone 5 (PYL)
Alpha chain:
MLLLLIPVLGMIFALRDARAQSVSQHNHHVILSEAASLELGCNYSYGGTVNLFWYVQYPG
QHLQLLLKYFSGDPLVKGIKGFEAEFIKSKFSFNLRKPSVQWSDTAEYFCAVKANFNKFYFGSGTKLNVKP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 699]
Beta chain:
MDTWLVCWAIFSLLKAGLTEPEVTQTPSHQVTQMGQEVILRCVPISNHLYFYWYRQILGQ
KVEFLVSFYNNEISEKSEIFDDQFSVERPDGSNFTLKIRSTKLEDSAMYFCASSWGNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 780]

Donor Y6W Clone 6 (PYL)
Alpha chain:
MKSLRVLLVILWLQLSWVWSQQKEVEQNSGPLSVPEGAIASLNCTYSDRGSQSFFWYRQY
SGKSPELIMFIYSNGDKEDGRFTAQLNKASQYVSLLIRDSQPSDSATYLCAAEPFSSYKLIFGSGTRLLVRP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 700]
Beta chain:
MGTRLLFWVAFCLLGADHTGAGVSQSPSNKVTEKGKDVELRCDPISGHTALYWYRQSLGQ
GLEFLIYFQGNSAPDKSGLPSDRFSAERTGGSVSTLTIQRTQQEDSAVYLCASSFIGGTGLNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 781]

Donor Y6W Clone 7 (PYL)
Alpha chain:
MMKCPQALLAIFWLLLSWVSSEDKVVQSPLSLVVHEGDTVTLNCSYEVTNFRSLLWYKQE
KKAPTFLFMLTSSGIEKKSGRLSSILDKKELSSILNITATQTGDSAIYLCAVESLIQGAQKLVFGQGTRLTINP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 701]
Beta chain:
MLLLLLLLGPGISLLLPGSLAGSGLGAVVSQHPSWVICKSGTSVKIECRSLDFQATTMFW
YRQFPKQSLMLMATSNEGSKATYEQGVEKDKFLINHASLTLSTLTVTSAHPEDSSFYICSARDRFWGTNNEKLFFGS
GTQLSVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 782]

FIG. 97 cont'd

Donor Y6W Clone 8 (PYL)
Alpha chain:
MRLVARVTVFLTFGTIIDAKTTQPPSMDCAEGRAANLPCNHSTISGNEYVYWYRQIHSQG
PQYIIHGLKNNETNEMASLIITEDRKSSTLILPHATLRDTAVYYCIVRVAGGTSYGKLTFGQGTILTVHP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 702]
Beta chain:
MLCSLLALLLGTFFGVRSQTIHQWPATLVQPVGSPLSLECTVEGTSNPNLYWYRQAAGRG
LQLLFYSVGIGQISSEVPQNLSASRPQDRQFILSSKKLLLSDSGFYLCAWSSAPDRGHRQPQHFGDGTRLSIL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO:783]

Donor Y6W Clone 9 (PYL)
Alpha chain:
MSLSSLLKVVTASLWLGPGIAQKITQTQPGMFVQEKEAVTLDCTYDTSDQSYGLFWYKQP
SSGEMIFLIYQGSYDEQNATEGRYSLNFQKARKSANLVISASQLGDSAMYFCAMRVNSGGYQKVTFGTGTKLQVIP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 703]
Beta chain:
MGPGLLHWMALCLLGTGHGDAMVIQNPRYQVTQFGKPVTLSCSQTLNHNVMYWYQQKSSQ
APKLLFHYYDKDFNNEADTPDNFQSRRPNTSFCFLDIRSPGLGDTAMYLCATSRDRGTGPPYEQYFGPGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 784]

Donor Y6W Clone 10 (PYL)
Alpha chain:
MISLRVLLVILWLQLSWVWSQRKEVEQDPGPFNVPEGATVAFNCTYSNSASQSFFWYRQD
CRKEPKLLMSVYSSGNEDGRFTAQLNRASQYISLLIRDSKLSDSATYLCVLSGAGSYQLTFGKGTKLSVIP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 704]
Beta chain:
MSIGLLCCVAFSLLWASPVNAGVTQTPKFQVLKTGQSMTLQCAQDMNHNSMYWYRQDPGM
GLRLIYYSASEGTTDKGEVPNGYNVSRLNKREFSLRLESAAPSQTSVYFCASSEWREETQYFGPGTRLLVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 785]

FIG. 97 cont'd

Donor Y6W Clone 11 (PYL)
Alpha chain:
MESFLGGVLLILWLQVDWVKSQKIEQNSEALNIQEGKTATLTCNYTNYSPAYLQWYRQDP
GRGPVFLLLIRENEKEKRKERLKVTFDTTLKQSLFHITASQPADSATYLCALDEGNTGFQKLVFGTGTRLLVSP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 705]
Beta chain:
MLCSLLALLLGTFFGVRSQTIHQWPATLVQPVGSPLSLECTVEGTSNPNLYWYRQAAGRG
LQLLFYSVGIGQISSEVPQNLSASRPQDRQFILSSKKLLLSDSGFYLCAWSGTDSSYEQYFGPGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 786]

Donor Y6W Clone 12 (PYL)
Alpha chain:
MWGVFLLYVSMKMGGTTGQNIDQPTEMTATEGAIVQINCTYQTSGFNGLFWYQQHAGEAP
TFLSYNVLDGLEEKGRFSSFLSRSKGYSYLLLKELQMKDSASRNTGFQKLVFGTGTRLLVSP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 706]
Beta chain:
MGIRLLCRVAFCFLAVGLVDVKVTQSSRYLVKRTGEKVFLECVQDMDHENMFWYRQDPGL
GLRLIYFSYDVKMKEKGDIPEGYSVSREKKERFSLILESASTNQTSMYLCASSPEQGAAGDEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 787]

Donor Y6W Clone 13 (PYL)
Alpha chain:
MLLELIPLLGIHFVLRTARAQSVTQPDIHITVSEGASLELRCNYSYGATPYLFWYVQSPG
QGLQLLLKYFSGDTLVQGIKGFEAEFKRSQSSFNLRKPSVHWSDAAEYFCAAPGVGSNSGYALNFGKGTSLLVTP
HIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 707]
Beta chain:
MGFRLLCCVAFCLLGAGPVDSGVTQTPKHLITATGQRVTLRCSPRSGDLSVYWYQQSLDQ
GLQFLIQYYNGEERAKGNILERFSAQQFPDLHSELNLSSLELGDSALYFCASSPSWAANSPLHFGNGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 788]

FIG. 97 cont'd

Donor Y6W Clone 14 (PYL)

Alpha chain:

MWGVFLLYVSMKMGGTTGQNIDQPTEMTATEGAIVQINCTYQTSGFNGLFWYQQHAGEAP
TFLSYNVLDGLEEKGRFSSFLSRSKGYSYLLLKELQMKDSASYLCAGEDQTGANNLFFGTGTRLTVIP
YIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 708]

Beta chain:

MGIRLLCRVAFCFLAVGLVDVKVTQSSRYLVKRTGEKVFLECVQDMDHENMFWYRQDPGL
GLRLIYFSYDVKMKEKGDIPEGYSVSREKKERFSLILESASTNQTSMYLCASGTLSYNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 789]

Donor Y6W Clone 15 (PYL)

Alpha chain:

MKSLRVLLVILWLQLSWVWSQQKEVEQNSGPLSVPEGAIASLNCTYSDRGSQSFFWYRQY
SGKSPELIMFIYSNGDKEDGRFTAQLNKASQYVSLLIRDSQPSDSATYLCAVKVGTGFQKLVFGTGTRLLVSP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 709]

Beta chain:

MGTSLLCWMALCLLGADHADTGVSQNPRHKITKRGQNVTFRCDPISEHNRLYWYRQTLGQ
GPEFLTYFQNEAQLEKSRLLSDRFSAERPKGSFSTLEIQRTEQGDSAMYLCASSLVGQGNTEAFFGQGTRLTVV
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 790]

FIG. 97 cont'd

**TCRs specific for HLA-A*02:01- YLLEMLWRL**

Donor N2W Clone 1 (YLL)

Alpha chain:

MLLLLIPVLGMIFALRDARAQSVSQHNHHVILSEAASLELGCNYSYGGTVNLFWYVQYPG
QHLQLLLKYFSGDPLVKGIKGFEAEFIKSKFSFNLRKPSVQWSDTAEYFCAVSMRFGAGTRLTVKP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 710]

Beta chain:

MGTRLLCWAALCLLGAELTEAGVAQSPRYKIIEKRQSVAFWCNPISGHATLYWYQQILGQ
GPKLLIQFQNNGVVDDSQLPKDRFSAERLKGVDSTLKIQPAKLEDSAVYLCASSLDEGTVTYEQYFGPGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 791]

Donor N2W Clone 2 (YLL)

Alpha chain:

MKSLRVLLVILWLQLSWVWSQQKEVEQNSGPLSVPEGAIASLNCTYSDRGSQSFFWYRQY
SGKSPELIMFIYSNGDKEDGRFTAQLNKASQYVSLLIRDSQPSDSATYLCAVNPTPSVGSNYKLTFGKGTLLTVNP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 711]

Beta chain:

MGFRLLCCVAFCLLGAGPVDSGVTQTPKHLITATGQRVTLRCSPRSGDLSVYWYQQSLDQ
GLQFLIQYYNGEERAKGNILERFSAQQFPDLHSELNLSSLELGDSALYFCASSVGGEGLAFFGQGTRLTVV
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 792]

Donor N2W Clone 3 (YLL)

Alpha chain:

MMKCPQALLAIFWLLLSWVSSEDKVVQSPLSLVVHEGDTVTLNCSYEVTNFRSLLWYKQE
KKAPTFLFMLTSSGIEKKSGRLSSILDKKELFSILNITATQTGDSAVYLCAVAAENYGQNFVFGPGTRLSVLP
YIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 712]

Beta chain:

MGTSLLCWVVLGFLGTDHTGAGVSQSPRYKVTKRGQDVALRCDPISGHVSLYWYRQALGQ
GPEFLTYFNYEAQQDKSGLPNDRFSAERPEGSISTLTIQRTEQRDSAMYRCASSLEGDYNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO:793]

FIG. 98

Donor N2W Clone 4 (YLL)

Alpha chain:

MEKNPLAAPLLILWFHLDCVSSILNVEQSPQSLHVQEGDSTNFTCSFPSSNFYALHWYRW
ETAKSPEALFVMTLNGDEKKKGRISATLNTKEGYSYLYIKGSQPEDSATYLCAFISSGSARQLTFGSGTQLTVLP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 713]

Beta chain:

MGTSLLCWVVLGFLGTDHTGAGVSQSPRYKVTKRGQDVALRCDPISGHVSLYWYRQALGQ
GPEFLTYFNYEAQQDKSGLPNDRFSAERPEGSISTLTIQRTEQRDSAMYRCASSLEADNEKLFFGSGTQLSVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO:794]

Donor N2W Clone 5 (YLL)

Alpha chain:

MSLSSLLKVVTASLWLGPGIAQKITQTQPGMFVQEKEAVTLDCTYDTSDQSYGLFWYKQP
SSGEMIFLIYQGSYDEQNATEGRYSLNFQKARKSANLVISASQLGDSAMYFCAMREDLRSNDKVIFGPGTSLSVIP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 714]

Beta chain:

MGFRLLCCVAFCLLGAGPVDSGVTQTPKHLITATGQRVTLRCSPRSGDLSVYWYQQSLDQ
GLQFLIQYYNGEERAKGNILERFSAQQFPDLHSELNLSSLELGDSALYFCASSVGDSGQAQYFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO:795]

Donor N2W Clone 6 (YLL)

Alpha chain:

MLLLLIPVLGMIFALRDARAQSVSQHNHHVILSEAASLELGCNYSYGGTVNLFWYVQYPG
QHLQLLLKYFSGDPLVKGIKGFEAEFIKSKFSFNLRKPSVQWSDTAEYFCAAGGGSQGNLIFGKGTKLSVKP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 715]

Beta chain:

MGPGLLCWALLCLLGAGLVDAGVTQSPTHLIKTRGQQVTLRCSPKSGHDTVSWYQQALGQ
GPQFIFQYYEEEERQRGNFPDRFSGHQFPNYSSELNVNALLLGDSALYLCASSWWDGGTGELFFGEGSRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 796]

FIG. 98 cont'd

Donor B87 Clone 1 (YLL)
Alpha chain:
MSLSSLLKVVTASLWLGPGIAQKITQTQPGMFVQEKEAVTLDCTYDTSDPSYGLFWYKQP
SSGEMIFLIYQGSYDQQNATEGRYSLNFQKARKSANLVISASQLGDSAMYFCAMRELNDYKLSFGAGTTVTVRA
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 716]
Beta chain:
MASLLFFCGAFYLLGTGSMDADVTQTPRNRITKTGKRIMLECSQTKGHDRMYWYRQDPGL
GLRLIYYSFDVKDINKGEISDGYSVSRQAQAKFSLSLESAIPNQTALYFCATRDDLLAEAFFGQGTRLTVV
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 797]

Donor B87 Clone 2 (YLL)
Alpha chain:
METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATDGLPRFGAGTRLTVKP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 717]
Beta chain:
MLSPDLPDSAWNTRLLCHVMLCLLGAVSVAAGVIQSPRHLIKEKRETATLKCYPIPRHDTVYWYQQGPGQ
DPQFLISFYEKMQSDKGSIPDRFSAQQFSDYHSELNMSSLELGDSALYFCASSFGTNTGELFFGEGSRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 798]

Donor B87 Clone 3 (YLL)
Alpha chain:
MLLLLIPVLGMIFALRDARAQSVSQHNHHVILSEAASLELGCNYSYGGTVNLFWYVQYPG
QHLQLLLKYFSGDPLVKGIKGFEAEFIKSKFSFNLRKPSVQWSDTAEYFCAVNRPSGGSNYKLTFGKGTLLTVNP
NIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 718]
Beta chain:
MSTRLLCWMALCLLGAELSEAEVAQSPRYKITEKSQAVAFWCDPISGHATLYWYRQILGQ
GPELLVQFQDESVVDDSQLPKDRFSAERLKGVDSTLKIQPAELGDSAMYLCASSFGQYNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 799]

FIG. 98 cont'd

**TCRs specific for HLA-A*02:01-FLYALALLL**

Donor J9B Clone 1 (FLY)

Alpha chain:

METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATTGNSGYSTLTFGKGTMLLVSP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 719]

Beta chain:

MSIGLLCCAALSLLWAGPVNAGVTQTPKFQVLKTGQSMTLQCAQDMNHEYMSWYRQDPGM
GLRLIHYSVGAGITDQGEVPNGYNVSRSTTEDFPLRLLSAAPSQTSVYFCASSYGGGYYGYTFGSGTRLTVV
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 800]

Donor J9B Clone 2 (FLY)

Alpha chain:

METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCARVGDSGYSTLTFGKGTMLLVSP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 720]

Beta chain:

MSIGLLCCAALSLLWAGPVNAGVTQTPKFQVLKTGQSMTLQCAQDMNHEYMSWYRQDPGM
GLRLIHYSVGAGITDQGEVPNGYNVSRSTTEDFPLRLLSAAPSQTSVYFCASSYQGTGAYGYTFGSGTRLTVV
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 801]

FIG. 99

Donor A5L Clone 1 (FLY)

Alpha chain:
METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATEGDSGYSTLTFGKGTMLLVSP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 721]

Beta chain:
MSIGLLCCAALSLLWAGPVNAGVTQTPKFQVLKTGQSMTLQCAQDMNHEYMSWYRQDPGM
GLRLIHYSVGAGITDQGEVPNGYNVSRSTTEDFPLRLLSAAPSQTSVYFCASSYQGGSYGYTFGSGTRLTVV
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 802]

Donor A5L Clone 2 (FLY)

Alpha chain:
METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATEGDSGYSTLTFGKGTMLLVSP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 722]

Beta chain:
MSIGLLCCAALSLLWAGPVNAGVTQTPKFQVLKTGQSMTLQCAQDMNHEYMSWYRQDPGM
GLRLIHYSVGAGITDQGEVPNGYNVSRSTTEDFPLRLLSAAPSQTSVYFCASSRQGGSYGYTFGSGTRLTVV
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 803]

Donor A5L Clone 3 (FLY)

Alpha chain:
METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATEGDSGYSTLTFGKGTMLLVSP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 723]

Beta chain:
MSIGLLCCAALSLLWAGPVNAGVTQTPKFQVLKTGQSMTLQCAQDMNHEYMSWYRQDPGM
GLRLIHYSVGAGITDQGEVPNGYNVSRSTTEDFPLRLLSAAPSQTSVYFCASSPQGGNYGYTFGSGTRLTVV
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 804]

FIG. 99 cont'd

Donor A5L Clone 4 (FLY)
Alpha chain:
METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATSGDSGYSTLTFGKGTMLLVSP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 724]
Beta chain:
MSIGLLCCAALSLLWAGPVNAGVTQTPKFQVLKTGQSMTLQCAQDMNHEYMSWYRQDPGM
GLRLIHYSVGAGITDQGEVPNGYNVSRSTTEDFPLRLLSAAPSQTSVYFCASSPQGGNYGYTFGSGTRLTVV
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 805]

Donor A5L Clone 5 (FLY)
Alpha chain:
METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATVGNSGYSTLTFGKGTMLLVSP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 725]
Beta chain:
MSIGLLCCAALSLLWAGPVNAGVTQTPKFQVLKTGQSMTLQCAQDMNHEYMSWYRQDPGM
GLRLIHYSVGAGITDQGEVPNGYNVSRSTTEDFPLRLLSAAPSQTSVYFCASSFQGGNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 806

Donor A5L Clone 6 (FLY)
Alpha chain:
METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATVGNSGYSTLTFGKGTMLLVSP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 726]
Beta chain:
MSIGLLCCAALSLLWAGPVNAGVTQTPKFQVLKTGQSMTLQCAQDMNHEYMSWYRQDPGM
GLRLIHYSVGAGITDQGEVPNGYNVSRSTTEDFPLRLLSAAPSQTSVYFCASSTQGGYQPQHFGDGTRLSIL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 807]

FIG. 99 cont'd

Donor A5L Clone 7 (FLY)
Alpha chain:
METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATVGDSGYSTLTFGKGTMLLVSP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 727]
Beta chain:
MSIGLLCCAALSLLWAGPVNAGVTQTPKFQVLKTGQSMTLQCAQDMNHEYMSWYRQDPGM
GLRLIHYSVGAGITDQGEVPNGYNVSRSTTEDFPLRLLSAAPSQTSVYFCASSRQGGIDGYTFGSGTRLTVV
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 808]

Donor A5L Clone 8 (FLY)
Alpha chain:
METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATVGNSGYSTLTFGKGTMLLVSP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 728]
Beta chain:
MSIGLLCCAALSLLWAGPVNAGVTQTPKFQVLKTGQSMTLQCAQDMNHEYMSWYRQDPGM
GLRLIHYSVGAGITDQGEVPNGYNVSRSTTEDFPLRLLSAAPSQTSVYFCASSKQGGNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 809]

Donor A5L Clone 9 (FLY)
Alpha chain:
METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATVGNSGYSTLTFGKGTMLLVSP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 729]
Beta chain:
MSIGLLCCAALSLLWAGPVNAGVTQTPKFQVLKTGQSMTLQCAQDMNHEYMSWYRQDPGM
GLRLIHYSVGAGITDQGEVPNGYNVSRSTTEDFPLRLLSAAPSQTSVYFCASSPQGGNEQFFGPGTRLTVL
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 810]

FIG. 99 cont'd

Donor T4W Clone 1 (FLY)
Alpha chain:
METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATEGNSGYSTLTFGKGTMLLVSP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 730]
Beta chain:
MSIGLLCCAALSLLWAGPVNAGVTQTPKFQVLKTGQSMTLQCAQDMNHEYMSWYRQDPGM
GLRLIHYSVGAGITDQGEVPNGYNVSRSTTEDFPLRLLSAAPSQTSVYFCASNRQGGNYGYTFGSGTRLTVV
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 811]

Donor T4W Clone 2 (FLY)
Alpha chain:
METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATEGDSGYSTLTFGKGTMLLVSP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 731]
Beta chain:
MSIGLLCCAALSLLWAGPVNAGVTQTPKFQVLKTGQSMTLQCAQDMNHEYMSWYRQDPGM
GLRLIHYSVGAGITDQGEVPNGYNVSRSTTEDFPLRLLSAAPSQTSVYFCASSRQGGNYGYTFGSGTRLTVV
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 812]

Donor T4W Clone 3 (FLY)
Alpha chain:
METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATEGNSGYSTLTFGKGTMLLVSP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 732]
Beta chain:
MSIGLLCCAALSLLWAGPVNAGVTQTPKFQVLKTGQSMTLQCAQDMNHEYMSWYRQDPGM
GLRLIHYSVGAGITDQGEVPNGYNVSRSTTEDFPLRLLSAAPSQTSVYFCASSQQGGDHYGYTFGSGTRLTVV
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 813]

FIG. 99 cont'd

Donor T4W Clone 4 (FLY)

Alpha chain:

METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATEGNSGYSTLTFGKGTMLLVSP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 733]

Beta chain:

MSIGLLCCAALSLLWAGPVNAGVTQTPKFQVLKTGQSMTLQCAQDMNHEYMSWYRQDPGM
GLRLIHYSVGAGITDQGEVPNGYNVSRSTTEDFPLRLLSAAPSQTSVYFCASSPQGGSRGYTFGSGTRLTVV
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 814]

Donor T4W Clone 5 (FLY)

Alpha chain:

METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATEGDSGYSTLTFGKGTMLLVSP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 734]

Beta chain:

MSIGLLCCAALSLLWAGPVNAGVTQTPKFQVLKTGQSMTLQCAQDMNHEYMSWYRQDPGM
GLRLIHYSVGAGITDQGEVPNGYNVSRSTTEDFPLRLLSAAPSQTSVYFCASRLQGGFNGYTFGSGTRLTVV
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 815]

Donor T4W Clone 6 (FLY)

Alpha chain:

METLLGVSLVILWLQLARVNSQQGEEDPQALSIQEGENATMNCSYKTSINNLQWYRQNSG
RGLVHLILIRSNEREKHSGRLRVTLDTSKKSSSLLITASRAADTASYFCATVGDSGYSTLTFGKGTMLLVSP
DIQNPDPAVYQLRDSKSSDKSVCLFTDFDSQTNVSQSKDSDVYITDKTVLDMRSMDFKSN
SAVAWSNKSDFACANAFNNSIIPEDTFFPSPESSCDVKLVEKSFETDTNLNFQNLSVIGF
RILLLKVAGFNLLMTLRLWSS [SEQ ID NO: 735]

Beta chain:

MSIGLLCCAALSLLWAGPVNAGVTQTPKFQVLKTGQSMTLQCAQDMNHEYMSWYRQDPGM
GLRLIHYSVGAGITDQGEVPNGYNVSRSTTEDFPLRLLSAAPSQTSVYFCASSVQGGAHEQYFGPGTRLTVT
EDLNKVFPPEVAVFEPSEAEISHTQKATLVCLATGFFPDHVELSWWVNGKEVHSGVSTDP
QPLKEQPALNDSRYCLSSRLRVSATFWQNPRNHFRCQVQFYGLSENDEWTQDRAKPVTQI
VSAEAWGRADCGFTSVSYQQGVLSATILYEILLGKATLYAVLVSALVLMAMVKRKDF [SEQ ID NO: 816]

FIG. 99 cont'd

T-CELL RECEPTORS AND USES THEREOF

CROSS REFERENCE TO RELATED APPLICATIONS

This application is a national phase entry pursuant to 35 U.S.C. § 371 of International Application No. PCT/AU2019/051165, filed 23 Oct. 2019, which claims the benefit of priority to Australian Application No. 2018904049, filed 25 Oct. 2018, both of which are incorporated by reference in their entirety.

TECHNICAL FIELD

THIS INVENTION relates to T-cell receptors (TCR) capable of recognising antigens from Epstein Barr Virus (EBV). The present invention also relates to the use of TCR gene transfer to produce EBV-specific T cells and their use to treat and/or prevent an EBV-associated disease, disorder or condition.

BACKGROUND

EBV is a member of the herpesvirus family that infects humans throughout the world. Studies show that over 95% of all adults have antibodies against this virus, meaning that they have been infected at some point in their lives [1]. EBV generally persists throughout life and rarely causes any problems. In some cases, however, EBV has been linked to the development of cancers and serious conditions, including Burkitt's lymphoma, Hodgkin lymphoma, nasopharyngeal carcinoma, post-transplant lymphoproliferative disorder, NKT cell lymphoma, diffuse large B-cell lymphoma, gastric cancer and multiple sclerosis [1-3]. EBV protein expression in most of the EBV-associated diseases is very restricted but, in many cases, the latent membrane protein (LMP) 2, LMP1 and EBNA1 proteins are expressed [1].

T cells detect foreign antigens in the form of short 8-15 amino acid peptides presented by major histocompatibility complex (MHC) molecules, which are termed human leukocyte antigens (HLA) in humans. T cells recognise peptide-MHC complexes via the T cell receptor (TCR) [4]. The TCR is a clonotypic, membrane-bound, glycosylated polypeptide comprised of two chains. In αβ T cells, these chains consist of the TCR α- and β-chains. To engage the vast repertoire of MHC-bound antigenic peptides, TCRs are diversified through the random rearrangement of V and J genes at the TCR α locus, and V, D, and J genes at the TCR β locus of developing thymic T cells. Further potential diversity is created through untemplated addition or deletion of a variable number of nucleotides at the V-(D)-J junctional sites called N regions. The regions of the TCR that make the majority of contacts with the peptide-MHC complex are called the complementarity-determining regions (CDR). The first and second CDRs of the TCR are germline encoded within the V gene segments (TRAV and TRBV), whereas the CDR3 regions are derived from the V-(D)-J and N regions [5].

In the laboratory, EBV transforms B lymphocytes into immortal lymphoblastoid cell lines (LCLs). Consistent with this, EBV-infected B lymphocytes frequently expand to dangerously high levels in patients being treated with immunosuppressive drugs that repress the immune response to EBV (e.g. in post-transplant lymphoproliferative disorder) [1]. Compelling evidence that CD8+ T lymphocytes play a major role in controlling EBV infection was provided by clinical trials showing that adoptive immunotherapy with in vitro expanded EBV-specific cytotoxic T lymphocytes (CTLs) can successfully treat post-transplant lymphoproliferative disorder [6]. Adoptive immunotherapy with in vitro expanded EBV-specific CTLs has also shown promise as a treatment option for Hodgkin lymphoma, nasopharyngeal carcinoma, and multiple sclerosis [6]. For these clinical trials, T cells specific for the EBV proteins LMP2, LMP1 and/or EBNA1 were utilized because these antigens are commonly expressed by the malignant cells in Hodgkin lymphoma, nasopharyngeal carcinoma or by EBV-infected B cells in the brain of MS patients [6-8]. Furthermore, T cell responses to these antigens are relatively weak in most EBV-exposed individuals [6].

Although adoptive T cell immunotherapy has shown encouraging efficacy in clinical trials for EBV-associated diseases and other cancer types, it is a labour-intensive and expensive treatment option, and it is often not possible to raise sufficient T cells that are specific for the target cells that need to be killed [6]. Accordingly, improved methods for the treatment of EBV-associated diseases, disorders and conditions are required.

SUMMARY

The present invention is predicated in part on the discovery of alpha and beta TCR chains having CDRs that recognize epitopes derived from the LMP1 and LMP2 antigens of EBV when presented in association with several frequently-occurring human leukocyte antigens.

Accordingly, one form of the invention is broadly directed to TCRs and their use in preventing and/or treating an EBV-associated disease, disorder or condition.

In a first aspect, the invention provides an isolated alpha chain of a T-cell receptor (TCR) or a fragment thereof, comprising at least one complementarity determining region (CDR) amino acid sequence according to any one of SEQ ID NOS:331-411 and/or Tables 2-7 or an amino acid sequence at least 70% identical thereto.

In one embodiment, the isolated alpha chain further comprises one or more further CDR amino acid sequences according to any one of SEQ ID NOS:7-87 and 169-249 and/or Tables 2-7 or an amino acid sequence at least 70% identical thereto.

In some embodiments, the isolated alpha chain comprises, consists essentially of, or consists of an amino acid sequence according to any one of SEQ ID NOS:655-735 and/or FIGS. 94 to 99, or an amino acid sequence at least 70% identical thereto.

In particular embodiments, the isolated alpha chain comprises a cysteine residue at position 48 of a constant region thereof.

The isolated alpha chain suitably comprises one or more amino acid substitutions at positions 90, 91, 92 and/or 93 of a constant region thereof. In particular embodiments, the isolated alpha chain comprises:

(a) a P to S substitution at position 90;
(b) an E to D substitution at position 91;
(c) a S to V substitution at position 92; and/or
(d) a S to P substitution at position 93.

In a second aspect, the invention provides an isolated beta chain of a TCR or a fragment thereof, comprising at least one CDR amino acid sequence according to any one of SEQ ID NOS:412-492 and/or Tables 2-7 or an amino acid sequence at least 70% identical thereto.

In certain embodiments, the isolated beta chain further comprises one or more further CDR amino acid sequences according to any one of SEQ ID NOS:88-168 and 250-330 and/or Tables 2-7 or an amino acid sequence at least 70% identical thereto.

In one preferred embodiment, the isolated beta chain comprises, consists essentially of, or consists of an amino acid sequence according to any one of SEQ ID NOS:736-816 and/or FIGS. 94 to 99, or an amino acid sequence at least 70% identical thereto.

Suitably, the isolated beta chain comprises a cysteine residue at position 57 of a constant region thereof.

In some embodiments, the isolated beta chain comprises one or more amino acid substitutions at positions 18, 22, 133, 136 and/or 139 of a constant region thereof.

In particular embodiments, the isolated beta chain comprises:

(a) an E to K substitution at position 18;

(b) a S to A substitution at position 22;

(c) a F to I substitution at position 133;

(d) a V to A substitution at position 136; and/or (e) a Q to H substitution at position 139.

In a third aspect, the invention provides an isolated TCR or TCR fragment for binding an antigen derived from an Epstein Barr Virus (EBV), the TCR comprising:

(i) an isolated alpha chain or fragment thereof according to the first aspect; and/or (ii) an isolated beta chain or fragment thereof according to the second aspect.

Suitably, the antigen is at least partly derived from latent membrane protein 1 (LMP-1) and/or latent membrane protein 2 (LMP-2).

In one embodiment, the alpha chain and the beta chain are joined by a linker.

In a fourth aspect, the invention provides an isolated nucleic acid encoding:

(i) an isolated alpha chain or fragment thereof according to the first aspect;

(ii) an isolated beta chain or fragment thereof according to the second aspect; or (iii) an isolated TCR or TCR fragment according to the third aspect.

In a fifth aspect, the invention provides a genetic construct comprising the isolated nucleic acid of the aforementioned aspect.

In a sixth aspect, the invention provides a host cell comprising the isolated nucleic acid of the fourth aspect and/or the genetic construct of the fifth aspect.

Preferably, the host cell is or comprises a T cell.

In a seventh aspect, the invention provides a method of producing an isolated alpha chain or fragment thereof, an isolated beta chain or fragment thereof and/or an isolated TCR or TCR fragment, said method comprising; (i) culturing the host cell of the aforementioned aspect; and (ii) isolating said alpha chain, beta chain and/or TCR from said host cell cultured in step (i).

In an eighth aspect, the invention provides an antibody or antibody fragment which binds and/or is raised against:

(i) an isolated alpha chain or fragment thereof according to the first aspect;

(ii) an isolated beta chain or fragment thereof according to the second aspect; or (iii) an isolated TCR or TCR fragment according to the third aspect.

In a ninth aspect, the invention provides a composition comprising:

(i) an isolated alpha chain or fragment thereof according to the first aspect;

(ii) an isolated beta chain or fragment thereof according to the second aspect;

(iii) an isolated TCR or TCR fragment according to the third aspect;

(iv) an isolated nucleic acid of the fourth aspect;

(v) a genetic construct according to the fifth aspect; and/or (vi) a host cell according to the sixth aspect;

and a pharmaceutically acceptable carrier, diluent or excipient.

In a tenth aspect, the invention provides a method of treating or preventing an EBV-associated disease, disorder or condition in a subject, said method including the step of administering a therapeutically effective amount of an isolated alpha chain or fragment thereof according to the first aspect, an isolated beta chain or fragment thereof according to the second aspect, an isolated TCR or TCR fragment according to the third aspect, an isolated nucleic acid of the fourth aspect, a genetic construct according to the fifth aspect, a host cell according to the sixth aspect, and/or the composition of the ninth aspect to the subject to thereby treat or prevent the EBV-associated disease, disorder or condition in the subject.

In an eleventh aspect, the invention provides a method of performing cellular immunotherapy in a subject having an EBV-associated disease, disorder or condition, said method including the step of administering a therapeutically effective amount of a host cell according to the sixth aspect and optionally a pharmaceutically acceptable carrier, diluent or excipient to the subject.

With respect to the methods of the tenth and eleventh aspects, the EBV-associated disease, disorder or condition suitably is or comprises a cancer. Preferably, the EBV-associated disease, disorder or condition is selected from the group consisting of nasopharyngeal carcinoma, NKT cell lymphoma, Hodgkin's Lymphoma, post-transplant lymphoproliferative disease, Burkitt's lymphoma, Diffuse large B-cell lymphoma, gastric cancer, and any combination thereof. In an alternative embodiment, the EBV-associated disease, disorder or condition suitably is or comprises multiple sclerosis.

Suitably, the isolated alpha chain or fragment thereof according to the first aspect, the isolated beta chain or fragment thereof according to the second aspect, the isolated TCR or TCR fragment according to the third aspect, the isolated nucleic acid of the fourth aspect, the genetic construct according to the fifth aspect, the host cell according to the sixth aspect, or the composition of the ninth aspect are for use in the method of the tenth aspect.

In particular embodiments, the host cell according to the sixth aspect is for use in the method of the eleventh aspect.

In a twelfth aspect, the invention provides a method of detecting or isolating a T-cell in a biological sample from a subject, the method including the step of contacting the biological sample with an antibody or antibody fragment according to the eighth aspect for a time and under conditions sufficient to thereby detect or isolate said T-cell.

In certain embodiments, the detected or isolated T-cell is suitable for use in cellular immunotherapy of an EBV-associated disease, disorder or condition.

Suitably, the T-cell comprises an alpha chain of the first aspect, a beta chain of the second aspect and/or a T-cell receptor according to the third aspect.

Suitably, the subject of the aforementioned aspects of the invention is a mammal.

Preferably, the subject is a human.

Throughout this specification, unless otherwise indicated, "comprise", "comprises" and "comprising" are used inclusively rather than exclusively, so that a stated integer or group of integers may include one or more other non-stated integers or groups of integers.

It will also be appreciated that the indefinite articles "a" and "an" are not to be read as singular indefinite articles or as otherwise excluding more than one or more than a single subject to which the indefinite article refers. For example, "a" protein includes one protein, one or more proteins or a plurality of proteins.

By "consist essentially of" is meant in this context that the isolated protein or each immunogenic fragment has one, two or no more than three amino acid residues in addition to the recited amino acid sequence. The additional amino acid residues may occur at the N- and/or C-termini of the recited amino acid sequence, although without limitation thereto.

BRIEF DESCRIPTION OF THE FIGURES

FIGS. 13 to 93. TCR nucleotide sequences: With codon optimization (using the JCat Codon Adaptation Tool: http://www.jcat.de), and a codon replacement within the constant region encoding a single cysteine on each receptor chain to promote the formation of an additional interchain disulfide bond and reduce TCR mispairing with endogenous TCR subunits (Ref.: Cohen et al., Cancer Res. 2007, 67:3898-3903).

FIGS. 94 to 99. TCR amino acid sequences (unmodified)

BRIEF DESCRIPTION OF THE SEQUENCES

Figure 1:
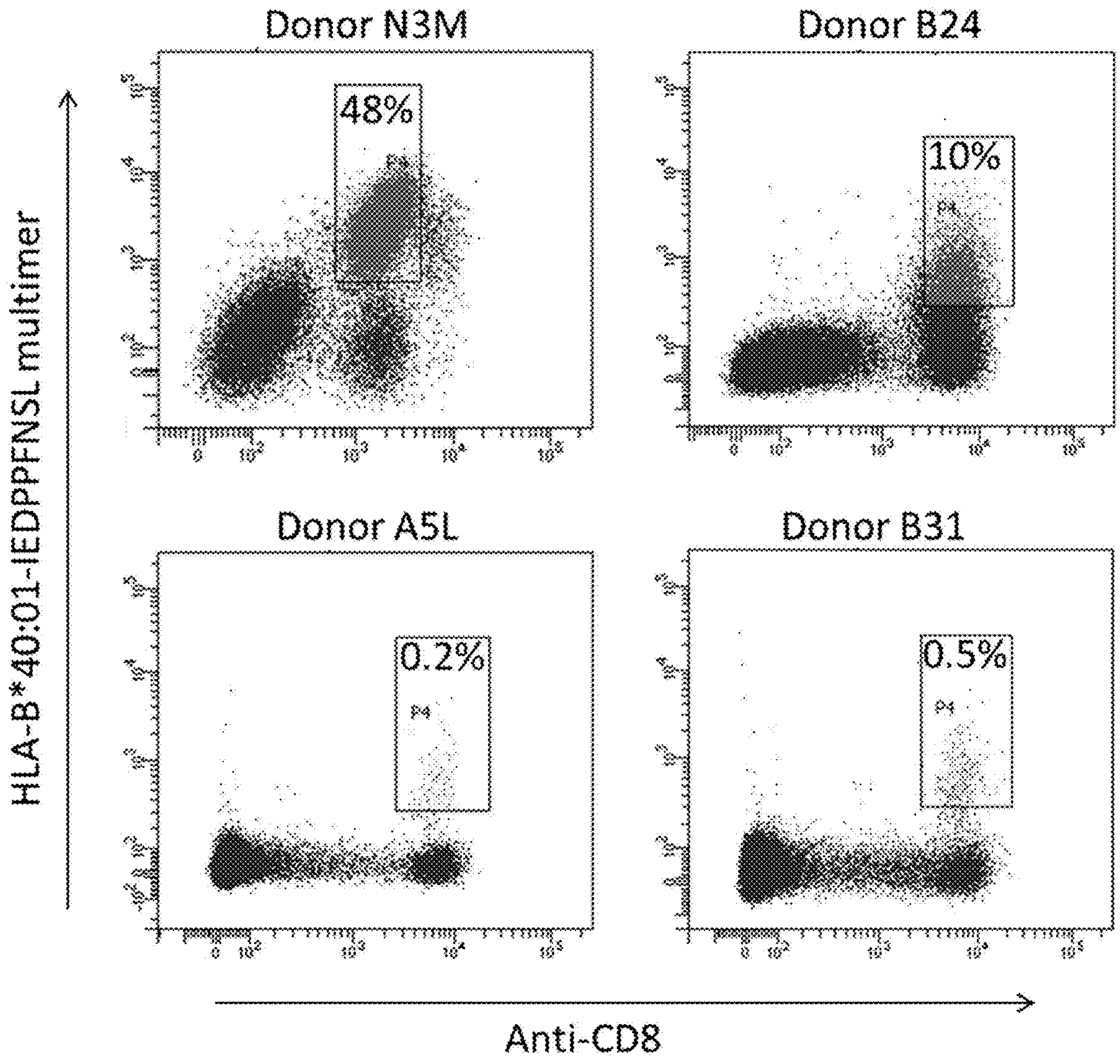
FIG. 1. Flow cytometry data for sorting of $CD8^+$ T cells specific for HLA-B*40:01-IEDPPFNSL for single cell TCR sequencing.
Figure 2:
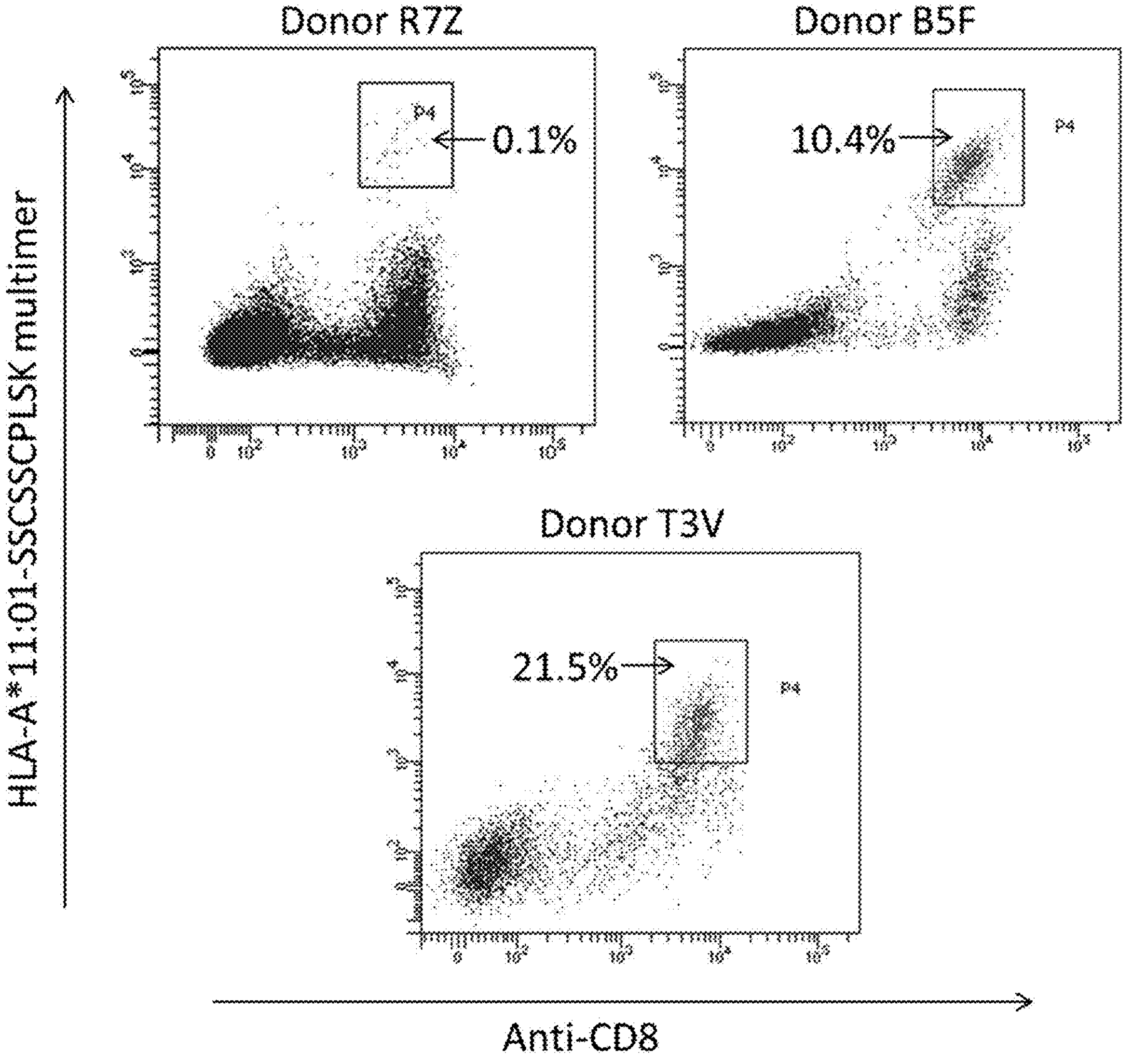
FIG. 2. Flow cytometry data for sorting of $CD8^+$ T cells specific for HLA-A*11:01-SSCSSCPLSK for single cell TCR sequencing.
Figure 3:
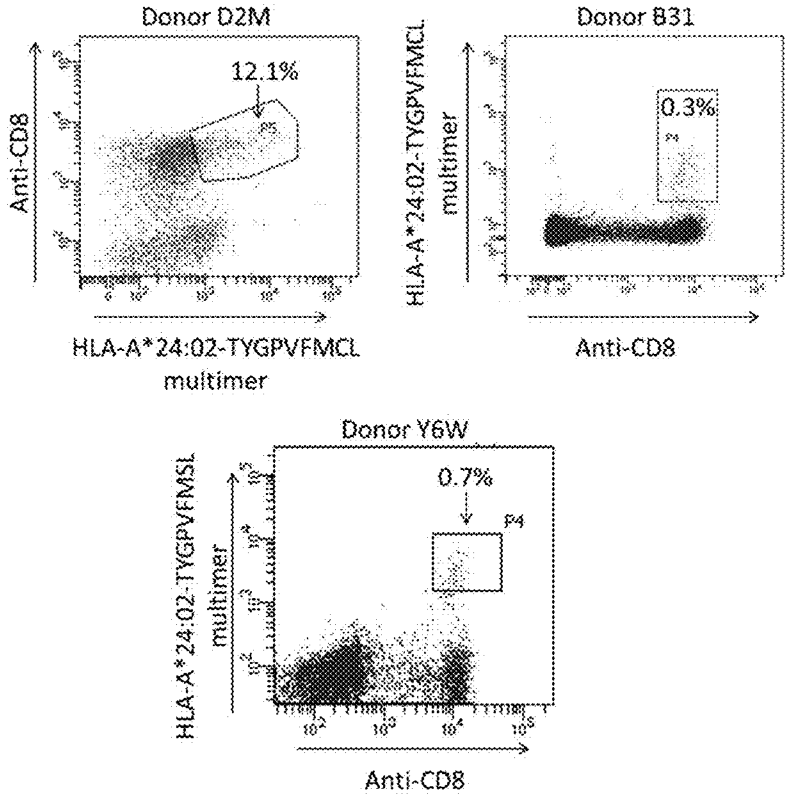
FIG. 3. Flow cytometry data for sorting of $CD8^+$ T cells specific for HLA-A*24:02-TYGPVFMCL (Donors D2M and B31) or HLA-A24:02-TYGPVFMSL (Donor Y6W) for single cell TCR sequencing.
Figure 4:
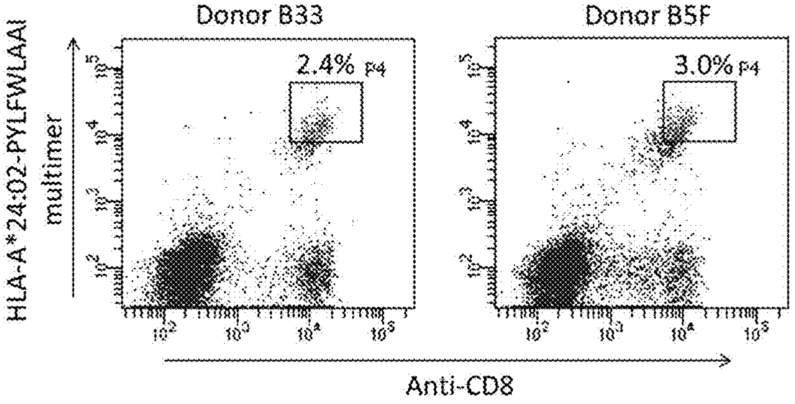
FIG. 4. Flow cytometry data for sorting of $CD8^+$ T cells specific for HLA-A*24:02-PYLFWLAAI for single cell TCR sequencing.
Figure 5:
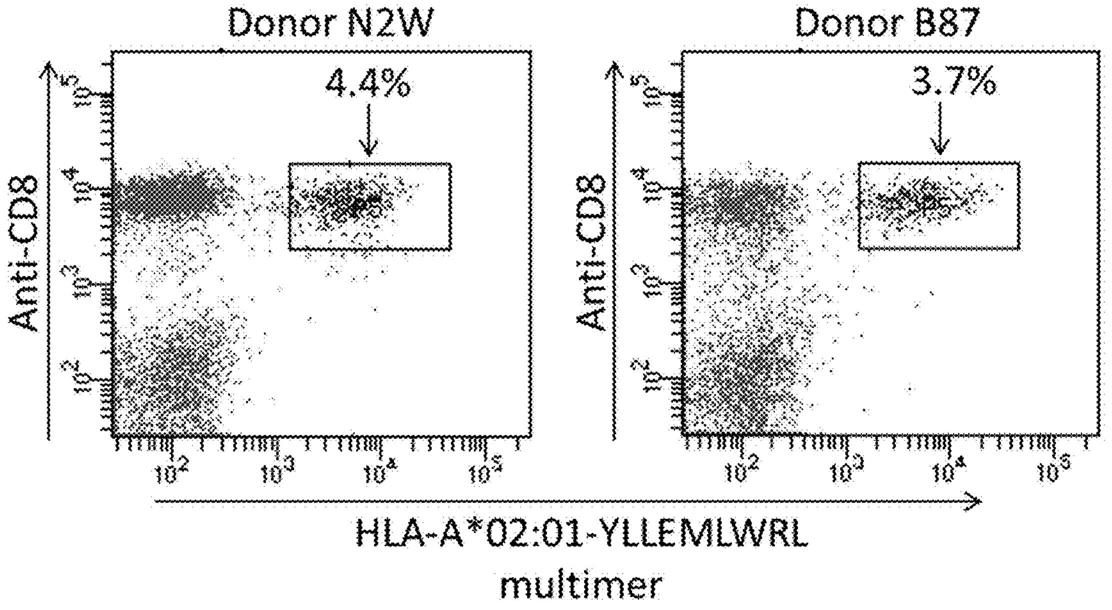
FIG. 5. Flow cytometry data for sorting of $CD8^+$ T cells specific for HLA-A*02:01-YLLEMLWRL for single cell TCR sequencing.
Figure 6:
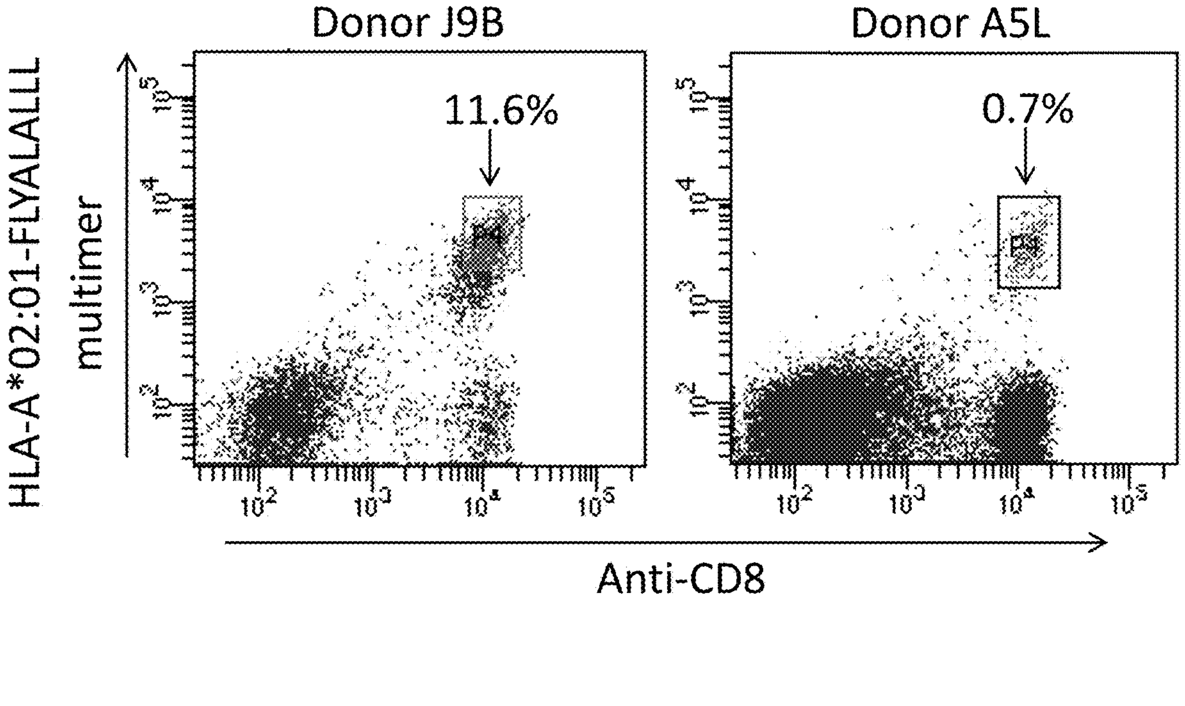
FIG. 6. Flow cytometry data for sorting of $CD8^+$ T cells specific for HLA-A*02:01-FLYALALLL for single cell TCR sequencing.

SEQ ID NO:1 LMP2 epitope IEDPPFNSL
SEQ ID NO:2 LMP2 epitope SSCSSCPLSK
SEQ ID NO:3 LMP2 epitope TYGPVFMSL
SEQ ID NO:4 LMP2 epitope PYLFWLAAI
SEQ ID NO:5 LMP1 epitope YLLEMLWRL
SEQ ID NO. 6 LMP2 epitope FLYALALLL
SEQ ID NO:7 CDR1 of α-chain of Clone 1 of Donor N3M in Table 2
SEQ ID NO:8 CDR1 of α-chain of Clone 1 of Donor B24 in Table 2
SEQ ID NO:9 CDR1 of α-chain of Clone 2 of Donor B24 in Table 2
SEQ ID NO:11 CDR1 of α-chain of Clone 3 of Donor B24 in Table 2
SEQ ID NO: 12 CDR1 of α-chain of Clone 4 of Donor B24 in Table 2
SEQ ID NO:12 CDR1 of α-chain of Clone 1 of Donor A5L in Table 2
SEQ ID NO:13 CDR1 of α-chain of Clone 2 of Donor A5L in Table 2
SEQ ID NO:14 CDR1 of α-chain of Clone 3 of Donor A5L in Table 2
SEQ ID NO:15 CDR1 of α-chain of Clone 4 of Donor A5L in Table 2
SEQ ID NO:16 CDR1 of α-chain of Clone 5 of Donor A5L in Table 2

SEQ ID NO:17 CDR1 of α-chain of Clone 2 of Donor B31 in Table 2

SEQ ID NO:18 CDR1 of α-chain of Clone 2 of Donor B31 in Table 2

SEQ ID NO:19 CDR1 of α-chain of Clone 1 of Donor R7Z in Table 3

SEQ ID NO:20 CDR1 of α-chain of Clone 2 of Donor R7Z in Table 3

SEQ ID NO:21 CDR1 of α-chain of Clone 3 of Donor R7Z in Table 3

SEQ ID NO:22 CDR1 of α-chain of Clone 4 of Donor R7Z in Table 3

SEQ ID NO:23 CDR1 of α-chain of Clone 5 of Donor R7Z in Table 3

SEQ ID NO:24 CDR1 of α-chain of Clone 1 of Donor B5F in Table 3

SEQ ID NO:25 CDR1 of α-chain of Clone 2 of Donor B5F in Table 3

SEQ ID NO:26 CDR1 of α-chain of Clone 1 of Donor T3V in Table 3

SEQ ID NO:27 CDR1 of α-chain of Clone 2 of Donor T3V in Table 3

SEQ ID NO:28 CDR1 of α-chain of Clone 3 of Donor T3V in Table 3

SEQ ID NO:29 CDR1 of α-chain of Clone 1 of Donor P6G in Table 3

SEQ ID NO:30 CDR1 of α-chain of Clone 2 of Donor P6G in Table 3

SEQ ID NO:31 CDR1 of α-chain of Clone 3 of Donor P6G in Table 3

SEQ ID NO:32 CDR1 of α-chain of Clone 1 of Donor A4T in Table 3

SEQ ID NO:33 CDR1 of α-chain of Clone 2 of Donor D2M in Table 4

SEQ ID NO:34 CDR1 of α-chain of Clone 2 of Donor D2M in Table 4

SEQ ID NO:35 CDR1 of α-chain of Clone 3 of Donor D2M in Table 4

SEQ ID NO:36 CDR1 of α-chain of Clone 2 of Donor B31 in Table 4

SEQ ID NO:37 CDR1 of α-chain of Clone 2 of Donor B31 in Table 4

SEQ ID NO:38 CDR1 of α-chain of Clone 3 of Donor B31 in Table 4

SEQ ID NO:39 CDR1 of α-chain of Clone 4 of Donor B31 in Table 4

SEQ ID NO:40 CDR1 of α-chain of Clone 5 of Donor B31 in Table 4

SEQ ID NO:41 CDR1 of α-chain of Clone 6 of Donor B31 in Table 4

SEQ ID NO:42 CDR1 of α-chain of Clone 1 of Donor Y6W in Table 4

SEQ ID NO:43 CDR1 of α-chain of Clone 2 of Donor Y6W in Table 4

SEQ ID NO:45 CDR1 of α-chain of Clone 3 of Donor Y6W in Table 4

SEQ ID NO:45 CDR1 of α-chain of Clone 1 of Donor B33 in Table 5

SEQ ID NO:46 CDR1 of α-chain of Clone 1 of Donor B5F in Table 5

SEQ ID NO:47 CDR1 of α-chain of Clone 1 of Donor Y6W in Table 5

SEQ ID NO:48 CDR1 of α-chain of Clone 2 of Donor Y6W in Table 5

SEQ ID NO:49 CDR1 of α-chain of Clone 3 of Donor Y6W in Table 5

SEQ ID NO:50 CDR1 of α-chain of Clone 4 of Donor Y6W in Table 5

SEQ ID NO:51 CDR1 of α-chain of Clone 5 of Donor Y6W in Table 5

SEQ ID NO:52 CDR1 of α-chain of Clone 6 of Donor Y6W in Table 5

SEQ ID NO:53 CDR1 of α-chain of Clone 7 of Donor Y6W in Table 5

SEQ ID NO:54 CDR1 of α-chain of Clone 8 of Donor Y6W in Table 5

SEQ ID NO:55 CDR1 of α-chain of Clone 9 of Donor Y6W in Table 5

SEQ ID NO:56 CDR1 of α-chain of Clone 10 of Donor Y6W in Table 5

SEQ ID NO:57 CDR1 of α-chain of Clone 11 of Donor Y6W in Table 5

SEQ ID NO:58 CDR1 of α-chain of Clone 12 of Donor Y6W in Table 5

SEQ ID NO:59 CDR1 of α-chain of Clone 13 of Donor Y6W in Table 5

SEQ ID NO:60 CDR1 of α-chain of Clone 14 of Donor Y6W in Table 5

SEQ ID NO:61 CDR1 of α-chain of Clone 15 of Donor Y6W in Table 5

SEQ ID NO:62 CDR1 of α-chain of Clone 1 of Donor N2W in Table 6

SEQ ID NO:63 CDR1 of α-chain of Clone 2 of Donor N2W in Table 6

SEQ ID NO:64 CDR1 of α-chain of Clone 3 of Donor N2W in Table 6

SEQ ID NO:65 CDR1 of α-chain of Clone 4 of Donor N2W in Table 6

SEQ ID NO:66 CDR1 of α-chain of Clone 5 of Donor N2W in Table 6

SEQ ID NO:67 CDR1 of α-chain of Clone 6 of Donor N2W in Table 6

SEQ ID NO:68 CDR1 of α-chain of Clone 1 of Donor B87 in Table 6

SEQ ID NO:69 CDR1 of α-chain of Clone 2 of Donor B87 in Table 6

SEQ ID NO:70 CDR1 of α-chain of Clone 3 of Donor B87 in Table 6

SEQ ID NO:71 CDR1 of α-chain of Clone 1 of Donor J9B in Table 7

SEQ ID NO:72 CDR1 of α-chain of Clone 2 of Donor J9B in Table 7

SEQ ID NO:73 CDR1 of α-chain of Clone 2 of Donor A5L in Table 7

SEQ ID NO:74 CDR1 of α-chain of Clone 2 of Donor A5L in Table 7

SEQ ID NO:75 CDR1 of α-chain of Clone 3 of Donor A5L in Table 7

SEQ ID NO:76 CDR1 of α-chain of Clone 4 of Donor A5L, in Table 7

SEQ ID NO:77 CDR1 of α-chain of Clone 5 of Donor A5L in Table 7

SEQ ID NO:78 CDR1 of α-chain of Clone 6 of Donor A5L in Table 7

SEQ ID NO:79 CDR1 of α-chain of Clone 7 of Donor A5L in Table 7

SEQ ID NO:80 CDR1 of α-chain of Clone 8 of Donor A5L in Table 7

SEQ ID NO:81 CDR1 of α-chain of Clone 9 of Donor A5 in Table 7

SEQ ID NO:82 CDR1 of α-chain of Clone 1 of Donor T4W in Table 7

SEQ ID NO:83 CDR1 of α-chain of Clone 2 of Donor T4W in Table 7
SEQ ID NO:84 CDR1 of α-chain of Clone 3 of Donor T4W in Table 7
SEQ ID NO:85 CDR1 of α-chain of Clone 4 of Donor T4W in Table 7
SEQ ID NO:86 CDR1 of α-chain of Clone 5 of Donor T4W in Table 7
SEQ ID NO:87 CDR1 of α-chain of Clone 6 of Donor T4W in Table 7
SEQ ID NO:88 CDR1 of β-chain of Clone 1 of Donor N3M in Table 2
SEQ ID NO:89 CDR1 of β-chain of Clone 1 of Donor B24 in Table 2
SEQ ID NO:90 CDR1 of β-chain of Clone 2 of Donor B24 in Table 2
SEQ ID NO:91 CDR1 of β-chain of Clone 3 of Donor B24 in Table 2
SEQ ID NO:92 CDR1 of β-chain of Clone 4 of Donor B24 in Table 2
SEQ ID NO:93 CDR1 of β-chain of Clone 1 of Donor A5L in Table 2
SEQ ID NO:94 CDR1 of β-chain of Clone 2 of Donor A5L in Table 2
SEQ ID NO:95 CDR1 of β-chain of Clone 3 of Donor A5L in Table 2
SEQ ID NO:96 CDR1 of β-chain of Clone 4 of Donor A5L in Table 2
SEQ ID NO:97 CDR1 of β-chain of Clone 5 of Donor A5L in Table 2
SEQ ID NO:98 CDR1 of β-chain of Clone 1 of Donor B31 in Table 2
SEQ ID NO:99 CDR1 of β-chain of Clone 2 of Donor B31 in Table 2
SEQ ID NO:100 CDR1 of β-chain of Clone 1 of Donor R7Z in Table 3
SEQ ID NO:102 CDR1 of β-chain of Clone 2 of Donor R7Z in Table 3
SEQ ID NO:102 CDR1 of β-chain of Clone 3 of Donor R7Z in Table 3
SEQ ID NO:103 CDR1 of β-chain of Clone 4 of Donor R7Z in Table 3
SEQ ID NO:104 CDR1 of β-chain of Clone 5 of Donor R7Z in Table 3
SEQ ID NO:105 CDR1 of β-chain of Clone 1 of Donor B5F in Table 3
SEQ ID NO:106 CDR1 of β-chain of Clone 2 of Donor B5 in Table 3
SEQ ID NO:107 CDR1 of β-chain of Clone 1 of Donor T3V in Table 3
SEQ ID NO:108 CDR1 of β-chain of Clone 2 of Donor T3V in Table 3
SEQ ID NO:109 CDR1 of β-chain of Clone 3 of Donor T3V in Table 3
SEQ ID NO: 110 CDR1 of β-chain of Clone 1 of Donor P6G in Table 3
SEQ ID NO:111 CDR1 of β-chain of Clone 2 of Donor P6G in Table 3
SEQ ID NO:112 CDR1 of β-chain of Clone 3 of Donor P6G in Table 3
SEQ ID NO: 113 CDR1 of β-chain of Clone 1 of Donor A4T in Table 3
SEQ ID NO:114 CDR1 of β-chain of Clone 1 of Donor D2M in Table 4
SEQ ID NO:115 CDR1 of β-chain of Clone 2 of Donor D2M in Table 4
SEQ ID NO:116 CDR1 of β-chain of Clone 3 of Donor D2M in Table 4
SEQ ID NO:117 CDR1 of β-chain of Clone 1 of Donor B31 in Table 4
SEQ ID NO:118 CDR1 of β-chain of Clone 2 of Donor B31 in Table 4
SEQ ID NO:119 CDR1 of β-chain of Clone 3 of Donor B31 in Table 4
SEQ ID NO:120 CDR1 of β-chain of Clone 4 of Donor B31 in Table 4
SEQ ID NO:121 CDR1 of β-chain of Clone 5 of Donor B31 in Table 4
SEQ ID NO:122 CDR1 of β-chain of Clone 6 of Donor B31 in Table 4
SEQ ID NO:123 CDR1 of β-chain of Clone 1 of Donor Y6W in Table 4
SEQ ID NO:124 CDR1 of β-chain of Clone 2 of Donor Y6W in Table 4
SEQ ID NO:125 CDR1 of β-chain of Clone 3 of Donor Y6W in Table 4
SEQ ID NO:126 CDR1 of β-chain of Clone 1 of Donor B33 in Table 5
SEQ ID NO:127 CDR1 of β-chain of Clone 1 of Donor B5F in Table 5
SEQ ID NO:128 CDR1 of β-chain of Clone 1 of Donor Y6W in Table 5
SEQ ID NO:129 CDR1 of β-chain of Clone 2 of Donor Y6W in Table 5
SEQ ID NO:130 CDR1 of β-chain of Clone 3 of Donor Y6W in Table 5
SEQ ID NO:131 CDR1 of β-chain of Clone 4 of Donor Y6W in Table 5
SEQ ID NO:132 CDR1 of β-chain of Clone 6 of Donor Y6W in Table 5
SEQ ID NO:133 CDR1 of β-chain of Clone 6 of Donor Y6W in Table 5
SEQ ID NO:134 CDR1 of β-chain of Clone 7 of Donor Y6W in Table 5
SEQ ID NO:135 CDR1 of β-chain of Clone 8 of Donor Y6W in Table 5
SEQ ID NO:136 CDR1 of β-chain of Clone 9 of Donor Y6W in Table 5
SEQ ID NO:137 CDR1 of β-chain of Clone 10 of Donor Y6W in Table 5
SEQ ID NO:138 CDR1 of β-chain of Clone 11 of Donor Y6W in Table 5
SEQ ID NO:139 CDR1 of β-chain of Clone 12 of Donor Y6W in Table 5
SEQ ID NO:140 CDR1 of β-chain of Clone 13 of Donor Y6W in Table 5
SEQ ID NO:141 CDR1 of β-chain of Clone 14 of Donor Y6W in Table 5
SEQ ID NO:142 CDR1 of β-chain of Clone 15 of Donor Y6W in Table 5
SEQ ID NO:143 CDR1 of β-chain of Clone 1 of Donor N2W in Table 6
SEQ ID NO: 144 CDR1 of β-chain of Clone 2 of Donor N2W in Table 6
SEQ ID NO:145 CDR1 of β-chain of Clone 3 of Donor N2W in Table 6
SEQ ID NO:146 CDR1 of β-chain of Clone 4 of Donor N2W in Table 6
SEQ ID NO:147 CDR1 of β-chain of Clone 5 of Donor N2W in Table 6
SEQ ID NO:148 CDR1 of β-chain of Clone 6 of Donor N2W in Table 6

SEQ ID NO:149 CDR1 of β-chain of Clone 1 of Donor B87 in Table 6
SEQ ID NO:150 CDR1 of β-chain of Clone 2 of Donor B87 in Table 6
SEQ ID NO:151 CDR1 of β-chain of Clone 3 of Donor B87 in Table 6
SEQ ID NO:152 CDR1 of β-chain of Clone 1 of Donor J9B in Table 7
SEQ ID NO:153 CDR1 of β-chain of Clone 2 of Donor J9B in Table 7
SEQ ID NO:154 CDR1 of β-chain of Clone 1 of Donor A5L in Table 7
SEQ ID NO:155 CDR1 of β-chain of Clone 2 of Donor A5L in Table 7
SEQ ID NO:156 CDR1 of β-chain of Clone 3 of Donor A5L in Table 7
SEQ ID NO:157 CDR1 of β-chain of Clone 4 of Donor A5L in Table 7
SEQ ID NO:158 CDR1 of β-chain of Clone 5 of Donor A5L in Table 7
SEQ ID NO:159 CDR1 of β-chain of Clone 6 of Donor A5L in Table 7
SEQ ID NO:160 CDR1 of β-chain of Clone 7 of Donor A5L in Table 7
SEQ ID NO:161 CDR1 of β-chain of Clone 8 of Donor A5L in Table 7
SEQ ID NO:162 CDR1 of β-chain of Clone 9 of Donor A5L in Table 7
SEQ ID NO:163 CDR1 of β-chain of Clone 1 of Donor T4W in Table 7
SEQ ID NO:164 CDR1 of β-chain of Clone 2 of Donor T4W in Table 7
SEQ ID NO:165 CDR1 of β-chain of Clone 3 of Donor T4W in Table 7
SEQ ID NO:166 CDR1 of β-chain of Clone 4 of Donor T4W in Table 7
SEQ ID NO:167 CDR1 of β-chain of Clone 5 of Donor T4W in Table 7
SEQ ID NO:168 CDR2 of β-chain of Clone 6 of Donor T4W in Table 7
SEQ ID NO:169 CDR2 of α-chain of Clone 1 of Donor N3M in Table 2
SEQ ID NO:170 CDR2 of α-chain of Clone 1 of Donor B24 in Table 2
SEQ ID NO:171 CDR2 of α-chain of Clone 2 of Donor B24 in Table 2
SEQ ID NO:172 CDR2 of α-chain of Clone 3 of Donor B24 in Table 2
SEQ ID NO:173 CDR2 of α-chain of Clone 1 of Donor B24 in Table 2
SEQ ID NO:174 CDR2 of α-chain of Clone 1 of Donor A5L in Table 2
SEQ ID NO:175 CDR2 of α-chain of Clone 2 of Donor A5L in Table 2
SEQ ID NO:176 CDR2 of α-chain of Clone 3 of Donor A5L in Table 2
SEQ ID NO:177 CDR2 of α-chain of Clone 4 of Donor A5L in Table 2
SEQ ID NO: 178 CDR2 of α-chain of Clone 5 of Donor A5L in Table 2
SEQ ID NO:179 CDR2 of α-chain of Clone 1 of Donor B31 in Table 2
SEQ ID NO:180 CDR2 of α-chain of Clone 2 of Donor B31 in Table 2
SEQ ID NO:181 CDR2 of α-chain of Clone 1 of Donor R7Z in Table 3
SEQ ID NO:182 CDR2 of α-chain of Clone 2 of Donor R7Z in Table 3
SEQ ID NO:183 CDR2 of α-chain of Clone 3 of Donor R7Z in Table 3
SEQ ID NO:184 CDR2 of α-chain of Clone 4 of Donor R7Z in Table 3
SEQ ID NO:185 CDR2 of α-chain of Clone 5 of Donor R7Z in Table 3
SEQ ID NO:186 CDR2 of α-chain of Clone 1 of Donor B5F in Table 3
SEQ ID NO:187 CDR2 of α-chain of Clone 2 of Donor B3F in Table 3
SEQ ID NO:188 CDR2 of α-chain of Clone 1 of Donor T3V in Table 3
SEQ ID NO:189 CDR2 of α-chain of Clone 2 of Donor T3V in Table 3
SEQ ID NO:190 CDR2 of α-chain of Clone 3 of Donor T3V in Table 3
SEQ ID NO:191 CDR2 of α-chain of Clone 1 of Donor P6G in Table 3
SEQ ID NO:192 CDR2 of α-chain of Clone 2 of Donor P6G in Table 3
SEQ ID NO:193 CDR2 of α-chain of Clone 3 of Donor P6G in Table 3
SEQ ID NO:194 CDR2 of α-chain of Clone 1 of Donor A4T in Table 3
SEQ ID NO:195 CDR2 of α-chain of Clone 1 of Donor D2M in Table 4
SEQ ID NO:196 CDR2 of α-chain of Clone 2 of Donor D2M in Table 4
SEQ ID NO:197 CDR2 of α-chain of Clone 3 of Donor D2M in Table 4
SEQ ID NO:198 CDR2 of α-chain of Clone 1 of Donor B31 in Table 4
SEQ ID NO:199 CDR2 of α-chain of Clone 2 of Donor B31 in Table 4
SEQ ID NO:200 CDR2 of α-chain of Clone 3 of Donor B31 in Table 4
SEQ ID NO:201 CDR2 of α-chain of Clone 4 of Donor B31 in Table 4
SEQ ID NO:202 CDR2 of α-chain of Clone 5 of Donor B31 in Table 4
SEQ ID NO:203 CDR2 of α-chain of Clone 6 of Donor 331 in Table 4
SEQ ID NO:204 CDR2 of α-chain of Clone 1 of Donor Y6W in Table 4
SEQ ID NO:205 CDR2 of α-chain of Clone 2 of Donor Y6W in Table 4
SEQ ID NO:206 CDR2 of α-chain of Clone 3 of Donor Y6W in Table 4
SEQ ID NO:207 CDR2 of α-chain of Clone 1 of Donor B33 in Table 5
SEQ ID NO:208 CDR2 of α-chain of Clone 1 of Donor Y6W in Table 5
SEQ ID NO:209 CDR2 of α-chain of Clone 1 of Donor Y6W in Table 5
SEQ ID NO:210 CDR2 of α-chain of Clone 2 of Donor Y6W in Table 5
SEQ ID NO:211 CDR2 of α-chain of Clone 3 of Donor Y6W in Table 5
SEQ ID NO:212 CDR2 of α-chain of Clone 4 of Donor Y6W in Table 5
SEQ ID NO:213 CDR2 of α-chain of Clone 5 of Donor Y6W in Table 5
SEQ ID NO:214 CDR2 of α-chain of Clone 6 of Donor Y6W in Table 5

SEQ ID NO:215 CDR2 of α-chain of Clone 7 of Donor Y6W in Table 5
SEQ ID NO:216 CDR2 of α-chain of Clone 8 of Donor Y6W in Table 5
SEQ ID NO:217 CDR2 of α-chain of Clone 9 of Donor Y6W in Table 5
SEQ ID NO:218 CDR2 of α-chain of Clone 10 of Donor Y6W in Table 5
SEQ ID NO:219 CDR2 of α-chain of Clone 11 of Donor Y6W in Table 5
SEQ ID NO:220 CDR2 of α-chain of Clone 12 of Donor Y6W in Table 5
SEQ ID NO:221 CDR2 of α-chain of Clone 13 of Donor Y6W in Table 5
SEQ ID NO:222 CDR2 of α-chain of Clone 14 of Donor Y6W in Table 5
SEQ ID NO:223 CDR2 of α-chain of Clone 15 of Donor Y6W in Table 5
SEQ ID NO:224 CDR2 of α-chain of Clone 1 of Donor N2W in Table 6
SEQ ID NO:225 CDR2 of α-chain of Clone 2 of Donor N2W in Table 6
SEQ ID NO:226 CDR2 of α-chain of Clone 3 of Donor N2W in Table 6
SEQ ID NO:227 CDR2 of α-chain of Clone 4 of Donor N2W in Table 6
SEQ ID NO:228 CDR2 of α-chain of Clone 5 of Donor N2W in Table 6
SEQ ID NO:229 CDR2 of α-chain of Clone 6 of Donor N2W in Table 6
SEQ ID NO:230 CDR2 of α-chain of Clone 1 of Donor B87 in Table 6
SEQ ID NO:231 CDR2 of α-chain of Clone 2 of Donor B87 in Table 6
SEQ ID NO:232 CDR2 of α-chain of Clone 3 of Donor B87 in Table 6
SEQ ID NO:233 CDR2 of α-chain of Clone 1 of Donor J9B in Table 7
SEQ ID NO:234 CDR2 of α-chain of Clone 2 of Donor J9 in Table 7
SEQ ID NO:235 CDR2 of α-chain of Clone 1 of Donor A5L in Table 7
SEQ ID NO:236 CDR2 of α-chain of Clone 2 of Donor A5L in Table 7
SEQ ID NO:237 CDR2 of α-chain of Clone 3 of Donor A5L in Table 7
SEQ ID NO:238 CDR2 of α-chain of Clone 4 of Donor A5L in Table 7
SEQ ID NO:239 CDR2 of α-chain of Clone 5 of Donor A5L in Table 7
SEQ ID NO:240 CDR2 of α-chain of Clone 6 of Donor A5L in Table 7
SEQ ID NO:241 CDR2 of α-chain of Clone 7 of Donor A5L in Table 7
SEQ ID NO:242 CDR2 of α-chain of Clone 8 of Donor A5L in Table 7
SEQ ID NO:243 CDR2 of α-chain of Clone 9 of Donor A5L in Table 7
SEQ ID NO:244 CDR2 of α-chain of Clone 1 of Donor T4W in Table 7
SEQ ID NO:245 CDR2 of α-chain of Clone 2 of Donor T4W in Table 7
SEQ ID NO:246 CDR2 of α-chain of Clone 3 of Donor T4W in Table 7
SEQ ID NO:247 CDR2 of α-chain of Clone 4 of Donor T4W in Table 7
SEQ ID NO:248 CDR2 of α-chain of Clone 5 of Donor T4W in Table 7
SEQ ID NO:249 CDR2 of α-chain of Clone 6 of Donor T4W in Table 7
SEQ ID NO:250 CDR2 of β-chain of Clone 1 of Donor N3M in Table 2
SEQ ID NO:251 CDR2 of β-chain of Clone 1 of Donor B24 in Table 2
SEQ ID NO:252 CDR2 of β-chain of Clone 2 of Donor B24 in Table 2
SEQ ID NO:253 CDR2 of β-chain of Clone 3 of Donor B24 in Table 2
SEQ ID NO:254 CDR2 of β-chain of Clone 4 of Donor B24 in Table 2
SEQ ID NO:255 CDR2 of β-chain of Clone 1 of Donor A5L in Table 2
SEQ ID NO:256 CDR2 of β-chain of Clone 2 of Donor A5L in Table 2
SEQ ID NO:257 CDR2 of β-chain of Clone 3 of Donor A5L in Table 2
SEQ ID NO:258 CDR2 of β-chain of Clone 4 of Donor A5L in Table 2
SEQ ID NO:259 CDR2 of β-chain of Clone 5 of Donor A5L in Table 2
SEQ ID NO:260 CDR2 of β-chain of Clone 1 of Donor B31 in Table 2
SEQ ID NO:261 CDR2 of β-chain of Clone 2 of Donor B31 in Table 2
SEQ ID NO:262 CDR2 of β-chain of Clone 1 of Donor R7Z in Table 3
SEQ ID NO:263 CDR2 of β-chain of Clone 2 of Donor R7Z in Table 3
SEQ ID NO:264 CDR2 of β-chain of Clone 3 of Donor R7Z in Table 3
SEQ ID NO:265 CDR2 of β-chain of Clone 4 of Donor R7Z in Table 3
SEQ ID NO:266 CDR2 of β-chain of Clone 5 of Donor R7Z in Table 3
SEQ ID NO:267 CDR2 of β-chain of Clone 1 of Donor B5F in Table 3
SEQ ID NO:268 CDR2 of β-chain of Clone 2 of Donor B5F in Table 3
SEQ ID NO:269 CDR2 of β-chain of Clone 1 of Donor T3V in Table 3
SEQ ID NO:270 CDR2 of β-chain of Clone 2 of Donor T3V in Table 3
SEQ ID NO:271 CDR2 of β-chain of Clone 3 of Donor T3V in Table 3
SEQ ID NO:272 CDR2 of β-chain of Clone 1 of Donor P6G in Table 3
SEQ ID NO:273 CDR2 of β-chain of Clone 2 of Donor P6G in Table 3
SEQ ID NO:274 CDR2 of β-chain of Clone 3 of Donor P6G in Table 3
SEQ ID NO:275 CDR2 of β-chain of Clone 1 of Donor A4T in Table 3
SEQ ID NO:276 CDR2 of β-chain of Clone 1 of Donor D2M in Table 4
SEQ ID NO:277 CDR2 of β-chain of Clone 2 of Donor D2M in Table 4
SEQ ID NO:278 CDR2 of β-chain of Clone 3 of Donor D2M in Table 4
SEQ ID NO:279 CDR2 of β-chain of Clone 1 of Donor B31 in Table 4
SEQ ID NO:280 CDR2 of β-chain of Clone 2 of Donor B31 in Table 4

SEQ ID NO:281 CDR2 of β-chain of Clone 3 of Donor B31 in Table 4
SEQ ID NO:282 CDR2 of β-chain of Clone 4 of Donor B31 in Table 4
SEQ ID NO:283 CDR2 of β-chain of Clone 5 of Donor B31 in Table 4
SEQ ID NO:284 CDR2 of β-chain of Clone 6 of Donor B31 in Table 4
SEQ ID NO:285 CDR2 of β-chain of Clone 1 of Donor Y6W in Table 4
SEQ ID NO:286 CDR2 of β-chain of Clone 2 of Donor Y6W in Table 4
SEQ ID NO:287 CDR2 of β-chain of Clone 3 of Donor Y6W in Table 4
SEQ ID NO:288 CDR2 of β-chain of Clone 1 of Donor B33 in Table 5
SEQ ID NO:289 CDR2 of β-chain of Clone 1 of Donor B5F in Table 5
SEQ ID NO:290 CDR2 of β-chain of Clone 1 of Donor Y6W in Table 5
SEQ ID NO:291 CDR2 of β-chain of Clone 2 of Donor Y6W in Table 5
SEQ ID NO:292 CDR2 of β-chain of Clone 3 of Donor Y6W in Table 5
SEQ ID NO:293 CDR2 of β-chain of Clone 4 of Donor Y6W in Table 5
SEQ ID NO:294 CDR2 of β-chain of Clone 5 of Donor Y6W in Table 5
SEQ ID NO:295 CDR2 of β-chain of Clone 6 of Donor Y6W in Table 5
SEQ ID NO:296 CDR2 of β-chain of Clone 7 of Donor Y6W in Table 5
SEQ ID NO:297 CDR2 of β-chain of Clone 8 of Donor Y6W in Table 5
SEQ ID NO:298 CDR2 of β-chain of Clone 9 of Donor Y6W in Table 5
SEQ ID NO:299 CDR2 of β-chain of Clone 10 of Donor Y6W in Table 5
SEQ ID NO:300 CDR2 of β-chain of Clone 11 of Donor Y6W in Table 5
SEQ ID NO:301 CDR2 of β-chain of Clone 12 of Donor Y6W in Table 5
SEQ ID NO:302 CDR2 of β-chain of Clone 13 of Donor Y6W in Table 5
SEQ ID NO:303 CDR2 of β-chain of Clone 14 of Donor Y6W in Table 5
SEQ ID NO:304 CDR2 of β-chain of Clone 15 of Donor Y6W in Table 5
SEQ ID NO:305 CDR2 of β-chain of Clone 1 of Donor N2W in Table 6
SEQ ID NO:306 CDR2 of β-chain of Clone 2 of Donor N2W in Table 6
SEQ ID NO:307 CDR2 of β-chain of Clone 3 of Donor N2W in Table 6
SEQ ID NO:308 CDR2 of β-chain of Clone 4 of Donor N2W in Table 6
SEQ ID NO:309 CDR2 of β-chain of Clone 5 of Donor N2W in Table 6
SEQ ID NO:310 CDR2 of β-chain of Clone 6 of Donor N2W in Table 6
SEQ ID NO:311 CDR2 of β-chain of Clone 1 of Donor B87 in Table 6
SEQ ID NO:312 CDR2 of β-chain of Clone 2 of Donor B87 in Table 6
SEQ ID NO:313 CDR2 of β-chain of Clone 3 of Donor B87 in Table 6
SEQ ID NO:314 CDR2 of β-chain of Clone 1 of Donor J9B in Table 7
SEQ ID NO:315 CDR2 of β-chain of Clone 2 of Donor J9B in Table 7
SEQ ID NO:316 CDR2 of β-chain of Clone 1 of Donor A5L in Table 7
SEQ ID NO:317 CDR2 of β-chain of Clone 2 of Donor A5L in Table 7
SEQ ID NO:318 CDR2 of β-chain of Clone 3 of Donor A5L in Table 7
SEQ ID NO:319 CDR2 of β-chain of Clone 4 of Donor A5L in Table 7
SEQ ID NO:320 CDR2 of β-chain of Clone 5 of Donor A5L in Table 7
SEQ ID NO:321 CDR2 of β-chain of Clone 6 of Donor A5L in Table 7
SEQ ID NO:322 CDR2 of β-chain of Clone 7 of Donor A5L in Table 7
SEQ ID NO:323 CDR2 of β-chain of Clone 8 of Donor A5L in Table 7
SEQ ID NO:324 CDR2 of β-chain of Clone 9 of Donor A5L in Table 7
SEQ ID NO:325 CDR2 of β-chain of Clone 1 of Donor T4W in Table 7
SEQ ID NO:326 CDR2 of β-chain of Clone 2 of Donor T4W in Table 7
SEQ ID NO:327 CDR2 of β-chain of Clone 3 of Donor T4W in Table 7
SEQ ID NO:328 CDR2 of β-chain of Clone 4 of Donor T4W in Table 7
SEQ ID NO:329 CDR2 of β-chain of Clone 5 of Donor T4W in Table 7
SEQ ID NO:330 CDR2 of β-chain of Clone 6 of Donor T4W in Table 7
SEQ ID NO:331 CDR3 of α-chain of Clone 1 of Donor N3M in Table 2
SEQ ID NO:332 CDR3 of α-chain of Clone 1 of Donor B24 in Table 2
SEQ ID NO:333 CDR3 of α-chain of Clone 2 of Donor B24 in Table 2
SEQ ID NO:334 CDR3 of α-chain of Clone 3 of Donor B24 in Table 2
SEQ ID NO:335 CDR3 of α-chain of Clone 4 of Donor B24 in Table 2
SEQ ID NO:336 CDR3 of α-chain of Clone 1 of Donor A5L in Table 2
SEQ ID NO:337 CDR3 of α-chain of Clone 2 of Donor A5L in Table 2
SEQ ID NO:338 CDR3 of α-chain of Clone 3 of Donor A5L in Table 2
SEQ ID NO:339 CDR3 of α-chain of Clone 4 of Donor A5L in Table 2
SEQ ID NO:340 CDR3 of α-chain of Clone 5 of Donor A5L in Table 2
SEQ ID NO:341 CDR3 of α-chain of Clone 1 of Donor B31 in Table 2
SEQ ID NO:342 CDR3 of α-chain of Clone 2 of Donor B31 in Table 2
SEQ ID NO:343 CDR3 of α-chain of Clone 1 of Donor R7Z in Table 3
SEQ ID NO:344 CDR3 of α-chain of Clone 2 of Donor R7Z in Table 3
SEQ ID NO:345 CDR3 of α-chain of Clone 3 of Donor R7Z in Table 3
SEQ ID NO:346 CDR3 of α-chain of Clone 4 of Donor R7Z in Table 3

SEQ ID NO:347 CDR3 of α-chain of Clone 5 of Donor R7Z in Table 3
SEQ ID NO:348 CDR3 of α-chain of Clone 1 of Donor B5F in Table 3
SEQ ID NO:349 CDR3 of α-chain of Clone 2 of Donor B5F in Table 3
SEQ ID NO:350 CDR3 of α-chain of Clone 1 of Donor T3V in Table 3
SEQ ID NO:351 CDR3 of α-chain of Clone 2 of Donor T3V in Table 3
SEQ ID NO:352 CDR3 of α-chain of Clone 3 of Donor T3V in Table 3
SEQ ID NO:353 CDR3 of α-chain of Clone 1 of Donor P6G in Table 3
SEQ ID NO:354 CDR3 of α-chain of Clone 2 of Donor P6G in Table 3
SEQ ID NO:355 CDR3 of α-chain of Clone 3 of Donor P6G in Table 3
SEQ ID NO:356 CDR3 of α-chain of Clone 1 of Donor A4T in Table 3
SEQ ID NO:357 CDR3 of α-chain of Clone 1 of Donor D2M in Table 4
SEQ ID NO:358 CDR3 of α-chain of Clone 2 of Donor D2M in Table 4
SEQ ID NO:359 CDR3 of α-chain of Clone 3 of Donor D2M in Table 4
SEQ ID NO:360 CDR3 of α-chain of Clone 2 of Donor B31 in Table 4
SEQ ID NO:361 CDR3 of α-chain of Clone 2 of Donor B31 in Table 4
SEQ ID NO:362 CDR3 of α-chain of Clone 3 of Donor B31 in Table 4
SEQ ID NO:363 CDR3 of α-chain of Clone 4 of Donor B31 in Table 4
SEQ ID NO:364 CDR3 of α-chain of Clone 5 of Donor B31 in Table 4
SEQ ID NO:365 CDR3 of α-chain of Clone 6 of Donor B31 in Table 4
SEQ ID NO:366 CDR3 of α-chain of Clone 1 of Donor Y6W in Table 4
SEQ ID NO:367 CDR3 of α-chain of Clone 2 of Donor Y6W in Table 4
SEQ ID NO:368 CDR3 of α-chain of Clone 3 of Donor Y6W in Table 4
SEQ ID NO:369 CDR3 of α-chain of Clone 1 of Donor B33 in Table 5
SEQ ID NO:370 CDR3 of α-chain of Clone 1 of Donor B5F in Table 5
SEQ ID NO:371 CDR3 of α-chain of Clone 1 of Donor Y6W in Table 5
SEQ ID NO:372 CDR3 of α-chain of Clone 2 of Donor Y6W in Table 5
SEQ ID NO:373 CDR3 of α-chain of Clone 3 of Donor Y6W in Table 5
SEQ ID NO:374 CDR3 of α-chain of Clone 4 of Donor Y6W in Table 5
SEQ ID NO:375 CDR3 of α-chain of Clone 5 of Donor Y6W in Table 5
SEQ ID NO:376 CDR3 of α-chain of Clone 6 of Donor Y6W in Table 5
SEQ ID NO:377 CDR3 of α-chain of Clone 7 of Donor Y6W in Table 5
SEQ ID NO:378 CDR3 of α-chain of Clone 8 of Donor Y6W in Table 5
SEQ ID NO:379 CDR3 of α-chain of Clone 9 of Donor Y6W in Table 5
SEQ ID NO:380 CDR3 of α-chain of Clone 10 of Donor Y6W in Table 5
SEQ ID NO:381 CDR3 of α-chain of Clone 11 of Donor Y6W in Table 5
SEQ ID NO:382 CDR3 of α-chain of Clone 12 of Donor Y6W in Table 5
SEQ ID NO:383 CDR3 of α-chain of Clone 13 of Donor Y6W in Table 5
SEQ ID NO:384 CDR3 of α-chain of Clone 14 of Donor Y6W in Table 5
SEQ ID NO:385 CDR3 of α-chain of Clone 15 of Donor Y6W in Table 5
SEQ ID NO:386 CDR3 of α-chain of Clone 1 of Donor N2W in Table 6
SEQ ID NO:387 CDR3 of α-chain of Clone 2 of Donor N2W in Table 6
SEQ ID NO:388 CDR3 of α-chain of Clone 3 of Donor N2W in Table 6
SEQ ID NO:389 CDR3 of α-chain of Clone 4 of Donor N2W in Table 6
SEQ ID N0390 CDR3 of α-chain of Clone 5 of Donor N2W in Table 6
SEQ ID NO:391 CDR3 of α-chain of Clone 6 of Donor N2W in Table 6
SEQ ID NO:392 CDR3 of α-chain of Clone 1 of Donor B87 in Table 6
SEQ ID NO:393 CDR3 of α-chain of Clone 2 of Donor B87 in Table 6
SEQ ID NO:394 CDR3 of α-chain of Clone 3 of Donor B87 in Table 6
SEQ ID NO:395 CDR3 of α-chain of Clone 1 of Donor J9B in Table 7
SEQ ID NO:396 CDR3 of α-chain of Clone 2 of Donor J9B in Table 7
SEQ ID NO:397 CDR3 of α-chain of Clone 1 of Donor A5L in Table 7
SEQ ID NO:398 CDR3 of α-chain of Clone 2 of Donor A5L in Table 7
SEQ ID NO:399 CDR3 of α-chain of Clone 3 of Donor A5L in Table 7
SEQ ID NO:400 CDR3 of α-chain of Clone 4 of Donor A5L in Table 7
SEQ ID NO:401 CDR3 of α-chain of Clone 5 of Donor A5L in Table 7
SEQ ID NO:402 CDR3 of α-chain of Clone 6 of Donor A5L in Table 7
SEQ ID NO:403 CDR3 of α-chain of Clone 7 of Donor A5L in Table 7
SEQ ID NO:404 CDR3 of α-chain of Clone 8 of Donor A5L in Table 7
SEQ ID NO:405 CDR3 of α-chain of Clone 9 of Donor A5L in Table 7
SEQ ID NO:406 CDR3 of α-chain of Clone 1 of Donor T4W in Table 7
SEQ ID NO:407 CDR3 of α-chain of Clone 2 of Donor T4W in Table 7
SEQ ID NO:408 CDR3 of α-chain of Clone 3 of Donor T4W in Table 7
SEQ ID NO:409 CDR3 of α-chain of Clone 4 of Donor T4W in Table 7
SEQ ID NO:410 CDR3 of α-chain of Clone 5 of Donor T4W in Table 7
SEQ ID NO:411 CDR3 of α-chain of Clone 6 of Donor T4W in Table 7
SEQ ID NO:412 CDR3 of β-chain of Clone 1 of Donor N3M in Table 2

SEQ ID NO:413 CDR3 of β-chain of Clone 1 of Donor B24 in Table 2
SEQ ID NO:414 CDR3 of β-chain of Clone 2 of Donor B24 in Table 2
SEQ ID NO:415 CDR3 of β-chain of Clone 3 of Donor B24 in Table 2
SEQ ID NO:416 CDR3 of β-chain of Clone 4 of Donor B24 in Table 2
SEQ ID NO:417 CDR3 of β-chain of Clone 1 of Donor A5L in Table 2
SEQ ID NO:418 CDR3 of β-chain of Clone 2 of Donor A5L in Table 2
SEQ ID NO:419 CDR3 of β-chain of Clone 3 of Donor A5L in Table 2
SEQ ID NO:420 CDR3 of β-chain of Clone 4 of Donor A5L in Table 2
SEQ ID NO:421 CDR3 of β-chain of Clone 5 of Donor A5L in Table 2
SEQ ID NO:422 CDR3 of β-chain of Clone 1 of Donor B31 in Table 2
SEQ ID NO:423 CDR3 of β-chain of Clone 2 of Donor B31 in Table 2
SEQ ID NO:424 CDR3 of β-chain of Clone 1 of Donor R7Z in Table 3
SEQ ID NO:425 CDR3 of β-chain of Clone 2 of Donor R7Z in Table 3
SEQ ID NO:426 CDR3 of β-chain of Clone 3 of Donor R7Z in Table 3
SEQ ID NO:427 CDR3 of β-chain of Clone 4 of Donor R7Z in Table 3
SEQ ID NO:428 CDR3 of β-chain of Clone 5 of Donor B5F in Table 3
SEQ ID NO:429 CDR3 of β-chain of Clone 1 of Donor B5F in Table 3
SEQ ID NO:430 CDR3 of β-chain of Clone 2 of Donor B5F in Table 3
SEQ ID NO:431 CDR3 of β-chain of Clone 1 of Donor T3V in Table 3
SEQ ID NO:432 CDR3 of β-chain of Clone 2 of Donor T3V in Table 3
SEQ ID NO:433 CDR3 of β-chain of Clone 3 of Donor T3V in Table 3
SEQ ID NO:434 CDR3 of β-chain of Clone 1 of Donor P6G in Table 3
SEQ ID NO:435 CDR3 of β-chain of Clone 2 of Donor P6G in Table 3
SEQ ID NO:436 CDR3 of β-chain of Clone 3 of Donor P6G in Table 3
SEQ ID NO:437 CDR3 of β-chain of Clone 1 of Donor A4T in Table 3
SEQ ID NO:438 CDR3 of β-chain of Clone 1 of Donor D2M in Table 4
SEQ ID NO:439 CDR3 of β-chain of Clone 2 of Donor D2M in Table 4
SEQ ID NO:440 CDR3 of β-chain of Clone 3 of Donor D2M in Table 4
SEQ ID NO:441 CDR3 of β-chain of Clone 1 of Donor B31 in Table 4
SEQ ID NO:442 CDR3 of β-chain of Clone 2 of Donor B31 in Table 4
SEQ ID NO:443 CDR3 of β-chain of Clone 3 of Donor B31 in Table 4
SEQ ID NO:444 CDR3 of β-chain of Clone 4 of Donor B31 in Table 4
SEQ ID NO:445 CDR3 of β-chain of Clone 5 of Donor B31 in Table 4
SEQ ID NO:446 CDR3 of β-chain of Clone 6 of Donor B31 in Table 4
SEQ ID NO:447 CDR3 of β-chain of Clone 1 of Donor Y6W in Table 4
SEQ ID NO:448 CDR3 of β-chain of Clone 2 of Donor Y6W in Table 4
SEQ ID NO:449 CDR3 of β-chain of Clone 3 of Donor Y6W in Table 4
SEQ ID NO:450 CDR3 of β-chain of Clone 1 of Donor B33 in Table 5
SEQ ID NO:451 CDR3 of β-chain of Clone 1 of Donor B5F in Table 5
SEQ ID NO:452 CDR3 of β-chain of Clone 1 of Donor Y6W in Table 5
SEQ ID NO:453 CDR3 of β-chain of Clone 2 of Donor Y6W in Table 5
SEQ ID NO:454 CDR3 of β-chain of Clone 3 of Donor Y6W in Table 5
SEQ ID NO:455 CDR3 of β-chain of Clone 4 of Donor Y6W in Table 5
SEQ ID NO:456 CDR3 of β-chain of Clone 5 of Donor Y6W in Table 5
SEQ ID NO:457 CDR3 of β-chain of Clone 6 of Donor Y6W in Table 5
SEQ ID NO:458 CDR3 of β-chain of Clone 7 of Donor Y6W in Table 5
SEQ ID NO:459 CDR3 of β-chain of Clone 8 of Donor Y6W in Table 5
SEQ ID NO:460 CDR3 of β-chain of Clone 9 of Donor Y6W in Table 5
SEQ ID NO:461 CDR3 of β-chain of Clone 10 of Donor Y6W in Table 5
SEQ ID NO:462 CDR3 of β-chain of Clone 11 of Donor Y6W in Table 5
SEQ ID NO:463 CDR3 of β-chain of Clone 12 of Donor Y6W in Table 5
SEQ ID NO:464 CDR3 of β-chain of Clone 13 of Donor Y6W in Table 5
SEQ ID NO:465 CDR3 of β-chain of Clone 14 of Donor Y6W in Table 5
SEQ ID NO:466 CDR3 of β-chain of Clone 15 of Donor Y6W in Table 5
SEQ ID NO:467 CDR3 of β-chain of Clone 1 of Donor N2W in Table 6
SEQ ID NO:468 CDR3 of β-chain of Clone 2 of Donor N2W in Table 6
SEQ ID NO:469 CDR3 of β-chain of Clone 3 of Donor N2W in Table 6
SEQ ID NO:470 CDR3 of β-chain of Clone 4 of Donor N2W in Table 6
SEQ ID NO:471 CDR3 of β-chain of Clone 5 of Donor N2W in Table 6
SEQ ID NO:472 CDR3 of β-chain of Clone 6 of Donor N2W in Table 6
SEQ ID NO:473 CDR3 of β-chain of Clone 1 of Donor B87 in Table 6
SEQ ID NO:474 CDR3 of β-chain of Clone 2 of Donor B87 in Table 6
SEQ ID NO:475 CDR3 of β-chain of Clone 3 of Donor B87 in Table 6
SEQ ID NO:476 CDR3 of β-chain of Clone 1 of Donor J9B in Table 7
SEQ ID NO:477 CDR3 of β-chain of Clone 2 of Donor J9B in Table 7
SEQ ID NO:478 CDR3 of β-chain of Clone 1 of Donor A5L in Table 7

SEQ ID NO:479 CDR3 of β-chain of Clone 2 of Donor A5L in Table 7

SEQ ID NO:480 CDR3 of β-chain of Clone 3 of Donor A5L in Table 7

SEQ ID NO:481 CDR3 of β-chain of Clone 4 of Donor A5L in Table 7

SEQ ID NO:482 CDR3 of β-chain of Clone 5 of Donor A5L in Table 7

SEQ ID NO:483 CDR3 of β-chain of Clone 6 of Donor A5L in Table 7

SEQ ID NO:484 CDR3 of β-chain of Clone 7 of Donor A5L in Table 7

SEQ ID NO:485 CDR3 of β-chain of Clone 8 of Donor A5L in Table 7

SEQ ID NO:486 CDR3 of β-chain of Clone 9 of Donor A5L in Table 7

SEQ ID NO:487 CDR3 of β-chain of Clone 1 of Donor T4W in Table 7

SEQ ID NO:488 CDR3 of β-chain of Clone 2 of Donor T4W in Table 7

SEQ ID NO:489 CDR3 of β-chain of Clone 3 of Donor T4W in Table 7

SEQ ID NO:490 CDR3 of β-chain of Clone 4 of Donor T4W in Table 7

SEQ ID NO:491 CDR3 of β-chain of Clone 5 of Donor T4W in Table 7

SEQ ID NO:492 CDR3 of β-chain of Clone 6 of Donor T4W in Table 7

SEQ ID NO:493 nucleotide sequence α-chain of Clone 1 of Donor N3M in FIG. 13

SEQ ID NO:494 nucleotide sequence of α-chain of Clone 1 of Donor B24 in FIG. 14

SEQ ID NO:495 nucleotide sequence of α-chain of Clone 2 of Donor B24 in FIG. 15

SEQ ID NO:496 nucleotide sequence of α-chain of Clone 3 of Donor B24 in FIG. 16

SEQ ID NO:497 nucleotide sequence of α-chain of Clone 4 of Donor B24 in FIG. 17

SEQ ID NO:498 nucleotide sequence of α-chain of Clone 1 of Donor A5L in FIG. 18

SEQ ID NO:499 nucleotide sequence of α-chain of Clone 2 of Donor A5L in FIG. 19

SEQ ID NO:500 nucleotide sequence of α-chain of Clone 3 of Donor A5L in FIG. 20

SEQ ID NO:501 nucleotide sequence of α-chain of Clone 4 of Donor A5L in FIG. 21

SEQ ID NO:502 nucleotide sequence of α-chain of Clone 5 of Donor A5L in FIG. 22

SEQ ID NO:503 nucleotide sequence of α-chain of Clone 1 of Donor B31 in FIG. 23

SEQ ID NO:504 nucleotide sequence of α-chain of Clone 2 of Donor B31 in FIG. 24

SEQ ID NO:505 nucleotide sequence of α-chain of Clone 1 of Donor R7Z in FIG. 25

SEQ ID NO:506 nucleotide sequence of α-chain of Clone 2 of Donor R7Z in FIG. 26

SEQ ID NO:507 nucleotide sequence of α-chain of Clone 3 of Donor R7Z in FIG. 27

SEQ ID NO:508 nucleotide sequence of α-chain of Clone 4 of Donor R7Z in FIG. 28

SEQ ID NO:509 nucleotide sequence of α-chain of Clone 5 of Donor R7Z in FIG. 29

SEQ ID NO:510 nucleotide sequence of α-chain of Clone 1 of Donor B5F in FIG. 30

SEQ ID NO:511 nucleotide sequence of α-chain of Clone 2 of Donor B5F in FIG. 31

SEQ ID NO:512 nucleotide sequence of α-chain of Clone 2 of Donor T3V in FIG. 32

SEQ ID NO:513 nucleotide sequence of α-chain of Clone 2 of Donor T3V in FIG. 33

SEQ ID NO:514 nucleotide sequence of α-chain of Clone 3 of Donor T3V in FIG. 34

SEQ ID NO:515 nucleotide sequence of α-chain of Clone 1 of Donor P6G in FIG. 35

SEQ ID NO:516 nucleotide sequence of α-chain of Clone 2 of Donor P6G in FIG. 36

SEQ ID NO:517 nucleotide sequence of α-chain of Clone 3 of Donor P6G in FIG. 37

SEQ ID NO:518 nucleotide sequence of α-chain of Clone 1 of Donor A4T in FIG. 38

SEQ ID NO:519 nucleotide sequence α-chain of Clone 1 of Donor D2M in FIG. 39

SEQ ID NO:520 nucleotide sequence α-chain of Clone 2 of Donor D2M in FIG. 40

SEQ ID NO:521 nucleotide sequence α-chain of Clone 3 of Donor D2M in FIG. 41

SEQ ID NO:522 nucleotide sequence of α-chain of Clone 1 of Donor B31 in FIG. 42

SEQ ID NO:523 nucleotide sequence of α-chain of Clone 2 of Donor B31 in FIG. 43

SEQ ID NO:524 nucleotide sequence of α-chain of Clone 3 of Donor B31 in FIG. 44

SEQ ID NO:525 nucleotide sequence of α-chain of Clone 4 of Donor B31 in FIG. 45

SEQ ID NO:526 nucleotide sequence of α-chain of Clone 6 of Donor B31 in FIG. 46

SEQ ID NO:527 nucleotide sequence of α-chain of Clone 6 of Donor B31 in FIG. 47

SEQ ID NO:528 nucleotide sequence α-chain of Clone 1 of Donor Y6W in FIG. 48

SEQ ID NO:529 nucleotide sequence α-chain of Clone 2 of Donor Y6W in FIG. 49

SEQ ID NO:530 nucleotide sequence α-chain of Clone 3 of Donor Y6W in FIG. 50

SEQ ID NO:531 nucleotide sequence of α-chain of Clone 1 of Donor B33 in FIG. 51

SEQ ID NO:532 nucleotide sequence of α-chain of Clone 1 of Donor B5F in FIG. 52

SEQ ID NO:533 nucleotide sequence α-chain of Clone 1 of Donor Y6W in FIG. 53

SEQ ID NO:534 nucleotide sequence α-chain of Clone 2 of Donor Y6W in FIG. 54

SEQ ID NO:535 nucleotide sequence α-chain of Clone 3 of Donor Y6W in FIG. 55

SEQ ID NO:536 nucleotide sequence α-chain of Clone 4 of Donor Y6W in FIG. 56

SEQ ID NO:537 nucleotide sequence α-chain of Clone 6 of Donor Y6W in FIG. 57

SEQ ID NO:538 nucleotide sequence α-chain of Clone 6 of Donor Y6W in FIG. 58

SEQ ID NO:539 nucleotide sequence α-chain of Clone 7 of Donor Y6W in FIG. 59

SEQ ID NO:540 nucleotide sequence α-chain of Clone 8 of Donor Y6W in FIG. 60

SEQ ID NO:541 nucleotide sequence α-chain of Clone 9 of Donor Y6W in FIG. 61

SEQ ID NO:542 nucleotide sequence α-chain of Clone 10 of Donor Y6W in FIG. 62

SEQ ID NO:543 nucleotide sequence α-chain of Clone 11 of Donor Y6W in FIG. 63

SEQ ID NO:544 nucleotide sequence α-chain of Clone 12 of Donor Y6W in FIG. 64

SEQ ID NO:545 nucleotide sequence α-chain of Clone 13 of Donor Y6W in FIG. 65
SEQ ID NO:546 nucleotide sequence α-chain of Clone 14 of Donor Y6W in FIG. 66
SEQ ID NO:547 nucleotide sequence α-chain of Clone 15 of Donor Y6W in FIG. 67
SEQ ID NO:548 nucleotide sequence α-chain of Clone 1 of Donor N2W in FIG. 68
SEQ ID NO:549 nucleotide sequence α-chain of Clone 2 of Donor N2W in FIG. 69
SEQ ID NO:550 nucleotide sequence α-chain of Clone 3 of Donor N2W in FIG. 70
SEQ ID NO:551 nucleotide sequence α-chain of Clone 4 of Donor N2W in FIG. 71
SEQ ID NO:552 nucleotide sequence α-chain of Clone 5 of Donor N2W in FIG. 72
SEQ ID NO:553 nucleotide sequence α-chain of Clone 6 of Donor N2W in FIG. 73
SEQ ID NO:554 nucleotide sequence α-chain of Clone 1 of Donor B87 in FIG. 74
SEQ ID NO:555 nucleotide sequence α-chain of Clone 2 of Donor B87 in FIG. 75
SEQ ID NO:556 nucleotide sequence α-chain of Clone 3 of Donor B87 in FIG. 76
SEQ ID NO:557 nucleotide sequence α-chain of Clone 1 of Donor J9B in FIG. 77
SEQ ID NO:558 nucleotide sequence α-chain of Clone 2 of Donor J9B in FIG. 78
SEQ ID NO:559 nucleotide sequence α-chain of Clone 1 of Donor A5L in FIG. 79
SEQ ID NO:560 nucleotide sequence α-chain of Clone 2 of Donor A5L in FIG. 80
SEQ ID NO:561 nucleotide sequence α-chain of Clone 3 of Donor A5L in FIG. 81
SEQ ID NO:562 nucleotide sequence α-chain of Clone 4 of Donor A5L in FIG. 82
SEQ ID NO:563 nucleotide sequence α-chain of Clone 5 of Donor A5L in FIG. 83
SEQ ID NO:564 nucleotide sequence α-chain of Clone 6 of Donor A5L in FIG. 84
SEQ ID NO:565 nucleotide sequence α-chain of Clone 7 of Donor A5L in FIG. 85
SEQ ID NO:566 nucleotide sequence α-chain of Clone 8 of Donor A5L in FIG. 86
SEQ ID NO:567 nucleotide sequence α-chain of Clone 9 of Donor A5L in FIG. 87
SEQ ID NO:568 nucleotide sequence α-chain of Clone 1 of Donor T4W in FIG. 88
SEQ ID NO:569 nucleotide sequence α-chain of Clone 2 of Donor T4W in FIG. 89
SEQ ID NO:570 nucleotide sequence α-chain of Clone 3 of Donor T4W in FIG. 90
SEQ ID NO:571 nucleotide sequence α-chain of Clone 4 of Donor T4W in FIG. 91
SEQ ID NO:572 nucleotide sequence α-chain of Clone 5 of Donor T4W in FIG. 92
SEQ ID NO:573 nucleotide sequence α-chain of Clone 6 of Donor T4W in FIG. 93
SEQ ID NO:574 nucleotide sequence β-chain of Clone 1 of Donor N3M in FIG. 13
SEQ ID NO:575 nucleotide sequence of β-chain of Clone 1 of Donor B24 in FIG. 14
SEQ ID NO:576 nucleotide sequence of β-chain of Clone 2 of Donor B24 in FIG. 15
SEQ ID NO:577 nucleotide sequence of β-chain of Clone 3 of Donor B24 in FIG. 16
SEQ ID NO:578 nucleotide sequence of β-chain of Clone 4 of Donor B24 in FIG. 17
SEQ ID NO:579 nucleotide sequence of β-chain of Clone 1 of Donor A5L in FIG. 18
SEQ ID NO:580 nucleotide sequence of β-chain of Clone 2 of Donor A5L in FIG. 19
SEQ ID NO:581 nucleotide sequence of β-chain of Clone 3 of Donor A5L in FIG. 20
SEQ ID NO:582 nucleotide sequence of β-chain of Clone 4 of Donor A5L in FIG. 21
SEQ ID NO:583 nucleotide sequence of β-chain of Clone 5 of Donor A5L in FIG. 22
SEQ ID NO:584 nucleotide sequence of β-chain of Clone 1 of Donor B31 in FIG. 23
SEQ ID NO:585 nucleotide sequence of β-chain of Clone 2 of Donor B31 in FIG. 24
SEQ ID NO:586 nucleotide sequence of β-chain of Clone 1 of Donor R7Z in FIG. 25
SEQ ID NO:587 nucleotide sequence of β-chain of Clone 2 of Donor R7Z in FIG. 26
SEQ ID NO:588 nucleotide sequence of β-chain of Clone 3 of Donor R7Z in FIG. 27
SEQ ID NO:589 nucleotide sequence of β-chain of Clone 4 of Donor R7Z in FIG. 28
SEQ ID NO:590 nucleotide sequence of β-chain of Clone 5 of Donor R7Z in FIG. 29
SEQ ID NO:591 nucleotide sequence of β-chain of Clone 1 of Donor B5F in FIG. 30
SEQ ID NO:592 nucleotide sequence of β-chain of Clone 2 of Donor B5F in FIG. 31
SEQ ID NO:593 nucleotide sequence of β-chain of Clone 1 of Donor T3V in FIG. 32
SEQ ID NO:594 nucleotide sequence of β-chain of Clone 2 of Donor T3V in FIG. 33
SEQ ID NO:595 nucleotide sequence of β-chain of Clone 3 of Donor T3V in FIG. 34
SEQ ID NO:596 nucleotide sequence of β-chain of Clone 1 of Donor P6G in FIG. 35
SEQ ID NO:597 nucleotide sequence of β-chain of Clone 2 of Donor P6G in FIG. 36
SEQ ID NO:598 nucleotide sequence of β-chain of Clone 3 of Donor P6G in FIG. 37
SEQ ID NO:599 nucleotide sequence of β-chain of Clone 1 of Donor A4T in FIG. 38
SEQ ID NO:600 nucleotide sequence β-chain of Clone 1 of Donor D2M in FIG. 39
SEQ ID NO:601 nucleotide sequence β-chain of Clone 2 of Donor D2M in FIG. 40
SEQ ID NO:602 nucleotide sequence β-chain of Clone 3 of Donor D2M in FIG. 41
SEQ ID NO:603 nucleotide sequence of β-chain of Clone 1 of Donor B31 in FIG. 42
SEQ ID NO:604 nucleotide sequence of β-chain of Clone 2 of Donor B31 in FIG. 43
SEQ ID NO:605 nucleotide sequence of β-chain of Clone 3 of Donor B31 in FIG. 44
SEQ ID NO:606 nucleotide sequence of β-chain of Clone 4 of Donor B31 in FIG. 45
SEQ ID NO:607 nucleotide sequence of β-chain of Clone 5 of Donor B31 in FIG. 46
SEQ ID NO:608 nucleotide sequence of β-chain of Clone 6 of Donor B31 in FIG. 47
SEQ ID NO:609 nucleotide sequence β-chain of Clone 1 of Donor Y6W in FIG. 48
SEQ ID NO:610 nucleotide sequence β-chain of Clone 2 of Donor Y6W in FIG. 49

SEQ ID NO:611 nucleotide sequence β-chain of Clone 3 of Donor Y6W in FIG. 50

SEQ ID NO:612 nucleotide sequence of β-chain of Clone 1 of Donor B33 in FIG. 51

SEQ ID NO:613 nucleotide sequence of β-chain of Clone 1 of Donor B5F in FIG. 52

SEQ ID NO:614 nucleotide sequence β-chain of Clone 1 of Donor Y6W in FIG. 53

SEQ ID NO:615 nucleotide sequence β-chain of Clone 2 of Donor Y6W in FIG. 54

SEQ ID NO:616 nucleotide sequence β-chain of Clone 3 of Donor Y6W in FIG. 55

SEQ ID NO:617 nucleotide sequence β-chain of Clone 4 of Donor Y6W in FIG. 56

SEQ ID NO:618 nucleotide sequence β-chain of Clone 5 of Donor Y6W in FIG. 57

SEQ ID NO:619 nucleotide sequence β-chain of Clone 6 of Donor Y6W in FIG. 58

SEQ ID NO:620 nucleotide sequence β-chain of Clone 7 of Donor Y6W in FIG. 59

SEQ ID NO:621 nucleotide sequence β-chain of Clone 8 of Donor Y6W in FIG. 60

SEQ ID NO:622 nucleotide sequence β-chain of Clone 9 of Donor Y6W in FIG. 61

SEQ ID NO:623 nucleotide sequence β-chain of Clone 10 of Donor Y6W in FIG. 62

SEQ ID-NO:624 nucleotide sequence β-chain of Clone 11 of Donor Y6W in FIG. 63

SEQ ID NO:625 nucleotide sequence β-chain of Clone 12 of Donor Y6W in FIG. 64

SEQ ID NO:626 nucleotide sequence β-chain of Clone 13 of Donor Y6W in FIG. 65

SEQ ID NO:627 nucleotide sequence β-chain of Clone 14 of Donor Y6W in FIG. 66

SEQ ID NO:628 nucleotide sequence β-chain of Clone 15 of Donor Y6W in FIG. 67

SEQ ID NO:629 nucleotide sequence β-chain of Clone 1 of Donor N2W in FIG. 68

SEQ ID NO:630 nucleotide sequence β-chain of Clone 2 of Donor N2W in FIG. 69

SEQ ID NO:631 nucleotide sequence β-chain of Clone 3 of Donor N2W in FIG. 70

SEQ ID NO:632 nucleotide sequence β-chain of Clone 4 of Donor N2W in FIG. 71

SEQ ID NO:633 nucleotide sequence β-chain of Clone 5 of Donor N2W in FIG. 72

SEQ ID NO:634 nucleotide sequence β-chain of Clone 6 of Donor N2W in FIG. 73

SEQ ID NO:635 nucleotide sequence β-chain of Clone 1 of Donor B87 in FIG. 74

SEQ ID NO:636 nucleotide sequence β-chain of Clone 2 of Donor B87 in FIG. 75

SEQ ID NO:637 nucleotide sequence β-chain of Clone 3 of Donor B87 in FIG. 76

SEQ ID NO:638 nucleotide sequence β-chain of Clone 1 of Donor J9B in FIG. 77

SEQ ID NO:639 nucleotide sequence β-chain of Clone 2 of Donor J9B in FIG. 78

SEQ ID NO:640 nucleotide sequence β-chain of Clone 1 of Donor A5L in FIG. 79

SEQ ID NO:641 nucleotide sequence β-chain of Clone 2 of Donor A5L in FIG. 80

SEQ ID NO:642 nucleotide sequence β-chain of Clone 3 of Donor A5L in FIG. 81

SEQ ID NO:643 nucleotide sequence β-chain of Clone 4 of Donor A5L in FIG. 82

SEQ ID NO:644 nucleotide sequence β-chain of Clone 5 of Donor A5L in FIG. 83

SEQ ID NO:645 nucleotide sequence β-chain of Clone 6 of Donor A5L in FIG. 84

SEQ ID NO:646 nucleotide sequence β-chain of Clone 7 of Donor A5L in FIG. 85

SEQ ID NO:647 nucleotide sequence β-chain of Clone 8 of Donor A5L in FIG. 86

SEQ ID NO:648 nucleotide sequence β-chain of Clone 9 of Donor A5L in FIG. 87

SEQ ID NO:649 nucleotide sequence β-chain of Clone 1 of Donor T4W in FIG. 88

SEQ ID NO:650 nucleotide sequence β-chain of Clone 2 of Donor T4W in FIG. 89

SEQ ID NO:651 nucleotide sequence β-chain of Clone 3 of Donor T4W in FIG. 90

SEQ ID NO:652 nucleotide sequence β-chain of Clone 4 of Donor T4W in FIG. 91

SEQ ID NO:653 nucleotide sequence β-chain of Clone 5 of Donor T4W in FIG. 92

SEQ ID NO:654 nucleotide sequence β-chain of Clone 6 of Donor T4W in FIG. 93

SEQ ID NO:655 amino acid sequence α-chain of Clone 1 of Donor N3M in FIG. 94

SEQ ID NO:656 amino acid sequence of α-chain of Clone 1 of Donor B24 in FIG. 94

SEQ ID NO:657 amino acid sequence of α-chain of Clone 2 of Donor B24 in FIG. 94

SEQ ID NO:658 amino acid sequence of α-chain of Clone 3 of Donor B24 in FIG. 94

SEQ ID NO:659 amino acid sequence α-chain of Clone 4 of Donor B24 in FIG. 94

SEQ ID NO:660 amino acid sequence α-chain of Clone 1 of Donor A5L in FIG. 94

SEQ ID NO:661 amino acid sequence α-chain of Clone 2 of Donor A5L in FIG. 94

SEQ ID NO:662 amino acid sequence α-chain of Clone 3 of Donor A5L in FIG. 94

SEQ ID NO:663 amino acid sequence α-chain of Clone 4 of Donor A5L in FIG. 94

SEQ ID NO:664 amino acid sequence α-chain of Clone 5 of Donor A5L in FIG. 94

SEQ ID NO:665 amino acid sequence of α-chain of Clone 1 of Donor B31 in FIG. 94

SEQ ID NO:666 amino acid sequence of α-chain of Clone 2 of Donor B31 in FIG. 94

SEQ ID NO:667 amino acid sequence of α-chain of Clone 1 of Donor R7Z in FIG. 95

SEQ ID NO:668 amino acid sequence of α-chain of Clone 2 of Donor R7Z in FIG. 95

SEQ ID NO:669 amino acid sequence of α-chain of Clone 3 of Donor R7Z in FIG. 95

SEQ ID NO:670 amino acid sequence of α-chain of Clone 4 of Donor R7Z in FIG. 95

SEQ ID NO:671 amino acid sequence of α-chain of Clone 1 of Donor R7Z in FIG. 95

SEQ ID NO:672 amino acid sequence of α-chain of Clone 1 of Donor B5F in FIG. 95

SEQ ID NO:673 amino acid sequence of α-chain of Clone 2 of Donor B5F in FIG. 95

SEQ ID NO:674 amino acid sequence α-chain of Clone 1 of Donor T3V in FIG. 95

SEQ ID NO:675 amino acid sequence α-chain of Clone 2 of Donor T3V in FIG. 95

SEQ ID NO:676 amino acid sequence α-chain of Clone 3 of Donor T3V in FIG. 95

SEQ ID NO:677 amino acid sequence α-chain of Clone 1 of Donor P6G in FIG. 95
SEQ ID NO:678 amino acid sequence α-chain of Clone 2 of Donor P6G in FIG. 95
SEQ ID NO:679 amino acid sequence α-chain of Clone 3 of Donor P6G in FIG. 95
SEQ ID NO:680 amino acid sequence α-chain of Clone 1 of Donor A4T in FIG. 95
SEQ ID NO:681 amino acid sequence α-chain of Clone 1 of Donor D2M in FIG. 96
SEQ ID NO:682 amino acid sequence α-chain of Clone 2 of Donor D2M in FIG. 96
SEQ ID NO:683 amino acid sequence α-chain of Clone 3 of Donor D2M in FIG. 96
SEQ ID NO:684 amino acid sequence of α-chain of Clone 1 of Donor B31 in FIG. 96
SEQ ID NO:685 amino acid sequence of α-chain of Clone 2 of Donor B31 in FIG. 96
SEQ ID NO:686 amino acid sequence of α-chain of Clone 3 of Donor B31 in FIG. 96
SEQ ID NO:687 amino acid sequence of α-chain of Clone 4 of Donor B31 in FIG. 96
SEQ ID NO:688 amino acid sequence of α-chain of Clone 5 of Donor B31 in FIG. 96
SEQ ID NO:689 amino acid sequence of α-chain of Clone 6 of Donor B31 in FIG. 96
SEQ ID NO:690 amino acid sequence α-chain of Clone 1 of Donor Y6W in FIG. 96
SEQ ID NO:691 amino acid sequence α-chain of Clone 2 of Donor Y6W in FIG. 96
SEQ ID NO:692 amino acid sequence α-chain of Clone 3 of Donor Y6W in FIG. 96
SEQ ID NO:693 amino acid sequence of α-chain of Clone 1 of Donor B33 in FIG. 97
SEQ ID NO:694 amino acid sequence of α-chain of Clone 1 of Donor B5F in FIG. 97
SEQ ID NO:695 amino acid sequence α-chain of Clone 1 of Donor Y6W in FIG. 97
SEQ ID NO:696 amino acid sequence α-chain of Clone 2 of Donor Y6W in FIG. 97
SEQ ID NO:697 amino acid sequence α-chain of Clone 3 of Donor Y6W in FIG. 97
SEQ ID NO:698 amino acid sequence α-chain of Clone 4 of Donor Y6W in FIG. 97
SEQ ID NO:699 amino acid sequence α-chain of Clone 5 of Donor Y6W in FIG. 97
SEQ ID NO:700 amino acid sequence α-chain of Clone 6 of Donor Y6W in FIG. 97
SEQ ID NO:701 amino acid sequence α-chain of Clone 7 of Donor Y6W in FIG. 97
SEQ ID NO:702 amino acid sequence α-chain of Clone 8 of Donor Y6W in FIG. 97
SEQ ID NO:703 amino acid sequence α-chain of Clone 9 of Donor Y6W in FIG. 97
SEQ ID NO:704 amino acid sequence α-chain of Clone 10 of Donor Y6W in FIG. 97
SEQ ID NO:705 amino acid sequence α-chain of Clone 11 of Donor Y6W in FIG. 97
SEQ ID NO:706 amino acid sequence α-chain of Clone 12 of Donor Y6W in FIG. 97
SEQ ID NO:707 amino acid sequence α-chain of Clone 13 of Donor Y6W in FIG. 97
SEQ ID NO:708 amino acid sequence α-chain of Clone 14 of Donor Y6W in FIG. 97
SEQ ID NO:709 amino acid sequence α-chain of Clone 15 of Donor Y6W in FIG. 97
SEQ ID NO:710 amino acid sequence α-chain of Clone 1 of Donor N2W in FIG. 98
SEQ ID NO:711 amino acid sequence α-chain of Clone 2 of Donor N2W in FIG. 98
SEQ ID NO:712 amino acid sequence α-chain of Clone 3 of Donor N2W in FIG. 98
SEQ ID NO:713 amino acid sequence α-chain of Clone 4 of Donor N2W in FIG. 98
SEQ ID NO:714 amino acid sequence α-chain of Clone 5 of Donor N2W in FIG. 98
SEQ ID NO:715 amino acid sequence α-chain of Clone 6 of Donor N2W in FIG. 98
SEQ ID NO:716 amino acid sequence of α-chain of Clone 1 of Donor B87 in FIG. 98
SEQ ID NO:717 amino acid sequence of α-chain of Clone 2 of Donor B87 in FIG. 98
SEQ ID NO:718 amino acid sequence of α-chain of Clone 3 of Donor B87 in FIG. 98
SEQ ID NO:719 amino acid sequence of α-chain of Clone 1 of Donor J9B in FIG. 99
SEQ ID NO:720 amino acid sequence α-chain of Clone 2 of Donor J9B in FIG. 99
SEQ ID NO:721 amino acid sequence α-chain of Clone 1 of Donor A5L in FIG. 99
SEQ ID NO:722 amino acid sequence α-chain of Clone 2 of Donor A5L in FIG. 99
SEQ ID NO:723 amino acid sequence α-chain of Clone 3 of Donor A5L in FIG. 99
SEQ ID NO:724 amino acid sequence α-chain of Clone 4 of Donor A5L in FIG. 99
SEQ ID NO:725 amino acid sequence α-chain of Clone 5 of Donor A5L in FIG. 99
SEQ ID NO:726 amino acid sequence α-chain of Clone 6 of Donor A5L in FIG. 99
SEQ ID NO:727 amino acid sequence α-chain of Clone 7 of Donor A5L in FIG. 99
SEQ ID NO:728 amino acid sequence α-chain of Clone 8 of Donor A5L in FIG. 99
SEQ ID NO:729 amino acid sequence α-chain of Clone 9 of Donor A5L in FIG. 99
SEQ ID NO:730 amino acid sequence α-chain of Clone 1 of Donor T4W in FIG. 99
SEQ ID NO:731 amino acid sequence α-chain of Clone 2 of Donor T4W in FIG. 99
SEQ ID NO:732 amino acid sequence α-chain of Clone 3 of Donor T4W in FIG. 99
SEQ ID NO:733 amino acid sequence α-chain of Clone 4 of Donor T4W in FIG. 99
SEQ ID NO:734 amino acid sequence α-chain of Clone 5 of Donor T4W in FIG. 99
SEQ ID NO:735 amino acid sequence α-chain of Clone 6 of Donor T4W in FIG. 99
SEQ ID NO:736 amino acid sequence β-chain of Clone 1 of Donor N3M in FIG. 94
SEQ ID NO:737 amino acid sequence β-chain of Clone 1 of Donor B24 in FIG. 94
SEQ ID NO:738 amino acid sequence β-chain of Clone 2 of Donor B24 in FIG. 94
SEQ ID NO:739 amino acid sequence β-chain of Clone 3 of Donor B24 in FIG. 94
SEQ ID NO:740 amino acid sequence β-chain of Clone 4 of Donor B24 in FIG. 94
SEQ ID NO:741 amino acid sequence β-chain of Clone 1 of Donor A5L in FIG. 94
SEQ ID NO:742 amino acid sequence β-chain of Clone 2 of Donor A5L in FIG. 94

SEQ ID NO:743 amino acid sequence β-chain of Clone 3 of Donor A5L in FIG. 94
SEQ ID NO:744 amino acid sequence β-chain of Clone 4 of Donor A5L in FIG. 94
SEQ ID NO:745 amino acid sequence β-chain of Clone 5 of Donor A5L in FIG. 94
SEQ ID NO:746 amino acid sequence β-chain of Clone 1 of Donor B31 in FIG. 94
SEQ ID NO:747 amino acid sequence β-chain of Clone 2 of Donor B31 in FIG. 94
SEQ ID NO:748 amino acid sequence β-chain of Clone 1 of Donor R7Z in FIG. 95
SEQ ID NO:749 amino acid sequence β-chain of Clone 2 of Donor R7Z in FIG. 95
SEQ ID NO:750 amino acid sequence β-chain of Clone 3 of Donor R7Z in FIG. 95
SEQ ID NO:751 amino acid sequence β-chain of Clone 4 of Donor R7Z in FIG. 95
SEQ ID NO:752 amino acid sequence β-chain of Clone 5 of Donor R7Z in FIG. 95
SEQ ID NO:753 amino acid sequence β-chain of Clone 1 of Donor B5F in FIG. 95
SEQ ID NO:754 amino acid sequence β-chain of Clone 2 of Donor B5F in FIG. 95
SEQ ID NO:755 amino acid sequence β-chain of Clone 1 of Donor T3V in FIG. 95
SEQ ID NO:756 amino acid sequence β-chain of Clone 2 of Donor T3V in FIG. 95
SEQ ID NO:757 amino acid sequence β-chain of Clone 3 of Donor T3V in FIG. 95
SEQ ID NO:758 amino acid sequence β-chain of Clone 1 of Donor P6G in FIG. 95
SEQ ID NO:759 amino acid sequence β-chain of Clone 2 of Donor P6G in FIG. 95
SEQ ID NO:760 amino acid sequence β-chain of Clone 3 of Donor P6G in FIG. 95
SEQ ID NO:761 amino acid sequence β-chain of Clone 1 of Donor A4T in FIG. 95
SEQ ID NO:762 amino acid sequence β-chain of Clone 1 of Donor D2M in FIG. 96
SEQ ID NO:763 amino acid sequence β-chain of Clone 2 of Donor D2M in FIG. 96
SEQ ID NO:764 amino acid sequence β-chain of Clone 3 of Donor D2M in FIG. 96
SEQ ID NO:765 amino acid sequence β-chain of Clone 1 of Donor B31 in FIG. 96
SEQ ID NO:766 amino acid sequence β-chain of Clone 2 of Donor B31 in FIG. 96
SEQ ID NO:767 amino acid sequence β-chain of Clone 3 of Donor B31 in FIG. 96
SEQ ID NO:768 amino acid sequence β-chain of Clone 4 of Donor B31 in FIG. 96
SEQ ID NO:769 amino acid sequence β-chain of Clone 5 of Donor B31 in FIG. 96
SEQ ID NO:770 amino acid sequence β-chain of Clone 6 of Donor B31 in FIG. 96
SEQ ID NO:771 amino acid sequence β-chain of Clone 1 of Donor Y6W in FIG. 96
SEQ ID NO:772 amino acid sequence β-chain of Clone 2 of Donor Y6W in FIG. 96
SEQ ID NO:773 amino acid sequence β-chain of Clone 3 of Donor Y6W in FIG. 96
SEQ ID NO:774 amino acid sequence β-chain of Clone 1 of Donor B33 in FIG. 97
SEQ ID NO:775 amino acid sequence β-chain of Clone 1 of Donor B5F in FIG. 97
SEQ ID NO:776 amino acid sequence β-chain of Clone 1 of Donor Y6W in FIG. 97
SEQ ID NO:777 amino acid sequence β-chain of Clone 2 of Donor Y6W in FIG. 97
SEQ ID NO:778 amino acid sequence β-chain of Clone 3 of Donor Y6W in FIG. 97
SEQ ID NO:779 amino acid sequence β-chain of Clone 4 of Donor Y6W in FIG. 97
SEQ ID NO:780 amino acid sequence β-chain of Clone 5 of Donor Y6W in FIG. 97
SEQ ID NO:781 amino acid sequence β-chain of Clone 6 of Donor Y6W in FIG. 97
SEQ ID NO:782 amino acid sequence β-chain of Clone 7 of Donor Y6W in FIG. 97
SEQ ID NO:783 amino acid sequence β-chain of Clone 8 of Donor Y6W in FIG. 97
SEQ ID NO:784 amino acid sequence β-chain of Clone 9 of Donor Y6W in FIG. 97
SEQ ID NO:785 amino acid sequence β-chain of Clone 10 of Donor Y6W in FIG. 97
SEQ ID NO:786 amino acid sequence β-chain of Clone 11 of Donor Y6W in FIG. 97
SEQ ID NO:787 amino acid sequence β-chain of Clone 12 of Donor Y6W in FIG. 97
SEQ ID NO:788 amino acid sequence β-chain of Clone 13 of Donor Y6W in FIG. 97
SEQ ID NO:789 amino acid sequence β-chain of Clone 14 of Donor Y6W in FIG. 97
SEQ ID NO:790 amino acid sequence β-chain of Clone 15 of Donor Y6W in FIG. 97
SEQ ID NO:791 amino acid sequence β-chain of Clone 1 of Donor N2W in FIG. 98
SEQ ID NO:792 amino acid sequence β-chain of Clone 2 of Donor N2W in FIG. 98
SEQ ID NO:793 amino acid sequence β-chain of Clone 3 of Donor N2W in FIG. 98
SEQ ID NO:794 amino acid sequence β-chain of Clone 4 of Donor N2W in FIG. 98
SEQ ID NO:795 amino acid sequence β-chain of Clone 5 of Donor N2W in FIG. 98
SEQ ID NO:796 amino acid sequence β-chain of Clone 6 of Donor N2W in FIG. 98
SEQ ID NO:797 amino acid sequence β-chain of Clone 1 of Donor B87 in FIG. 98
SEQ ID NO:798 amino acid sequence β-chain of Clone 2 of Donor B87 in FIG. 98
SEQ ID NO:799 amino acid sequence β-chain of Clone 3 of Donor B87 in FIG. 98
SEQ ID NO:800 amino acid sequence β-chain of Clone 1 of Donor J9B in FIG. 99
SEQ ID NO:801 amino acid sequence β-chain of Clone 2 of Donor J9B in FIG. 99
SEQ ID NO:802 amino acid sequence β-chain of Clone 1 of Donor A5L in FIG. 99
SEQ ID NO:803 amino acid sequence β-chain of Clone 2 of Donor A5L in FIG. 99
SEQ ID NO:804 amino acid sequence β-chain of Clone 3 of Donor A5L in FIG. 99
SEQ ID NO:805 amino acid sequence β-chain of Clone 4 of Donor A5L in FIG. 99
SEQ ID NO:806 amino acid sequence β-chain of Clone 5 of Donor A5L in FIG. 99
SEQ ID NO:807 amino acid sequence β-chain of Clone 6 of Donor A5L in FIG. 99
SEQ ID NO:808 amino acid sequence β-chain of Clone 7 of Donor A5L in FIG. 99

SEQ ID NO:809 amino acid sequence β-chain of Clone 8 of Donor A5L in FIG. 99

SEQ ID NO:810 amino acid sequence β-chain of Clone 9 of Donor A5L in FIG. 99

SEQ ID NO:811 amino acid sequence β-chain of Clone 1 of Donor T4W in FIG. 99

SEQ ID NO:812 amino acid sequence β-chain of Clone 2 of Donor T4W in FIG. 99

SEQ ID NO:813 amino acid sequence β-chain of Clone 3 of Donor T4W in FIG. 99

SEQ ID NO:814 amino acid sequence β-chain of Clone 4 of Donor T4W in FIG. 99

SEQ ID NO:815 amino acid sequence β-chain of Clone 5 of Donor T4W in FIG. 99

SEQ ID NO:816 amino acid sequence β-chain of Clone 6 of Donor T4W in FIG. 99

DETAILED DESCRIPTION

The present invention arises, in part, from the identification of sequences of TCR complementarity determining regions (CDRs) that recognize epitopes derived from EBV antigens and presented in association with several frequently-occurring human leukocyte antigens. These TCRs may be particularly suitable for the production of genetically engineered T cells and their administration to humans to prevent and/or treat an EBV-associated disease, disorder or condition, such as an EBV-positive cancer.

In a first aspect, the invention provides an isolated alpha chain of a T-cell receptor (TCR) or a fragment thereof, comprising at least one complementarity determining region (CDR) amino acid sequence (e.g., a CDR3 amino acid sequence) according to any one of SEQ ID NOS:331-411 and/or Tables 2-7 or an amino acid sequence at least 70% identical thereto.

For the purposes of this invention, the term "isolated" refers to material, such as the alpha chain, beta chain and TCR proteins or peptides described herein, that has been removed from its natural state or otherwise been subjected to human manipulation. Isolated material may be substantially or essentially free from components that normally accompany it in its natural state, or may be manipulated so as to be in an artificial state together with components that normally accompany it in its natural state. Isolated material may be in native, chemical synthetic or recombinant form. Isolated material may also, or alternatively, be in enriched, partially purified or purified form.

It will be understood that a T cell receptor or TCR is the molecule found on the surface of T cells that is responsible for recognizing antigenic peptides bound to MHC or HLA molecules. The TCR heterodimer typically includes an alpha chain and a beta chain in 95% of T cells, whereas 5% of T cells generally have TCRs consisting of gamma and delta chains.

With respect to the alpha and beta chains, these generally broadly comprise variable, joining and constant regions, and the beta chain also usually contains a short diversity region between the variable and joining regions, but this diversity region is often considered as part of the joining region. Each variable region comprises three CDRs (i.e., CDR1, CDR2 and CDR3) embedded in a framework sequence, one being the hypervariable region named CDR3. There are typically several types of alpha chain variable (Vα) regions and several types of beta chain variable (Vβ) regions known in the art and as distinguished by their framework, CDR1 and CDR2 sequences, and by a partly defined CDR3 sequence.

Accordingly, the alpha chain proteins or peptides of the present aspects, inclusive of fragments thereof, may further comprise one or more further CDR amino acid sequences, such as CDR1 and/or CDR2 amino acid sequences, according to any one of SEQ ID NOS:7-87 and 169-249 and/or Tables 2-7 or an amino acid sequence at least 70% identical thereto.

In some embodiments, the alpha chain of the present aspect comprises, consists essentially of, or consists of an amino acid sequence according to any one of SEQ ID NOS:655-735 and/or FIGS. 94 to 99, or an amino acid sequence at least 70% identical thereto.

In particular embodiments, the isolated alpha chain comprises a cysteine residue, such as at position 48 of a constant region thereof. It will be appreciated that such a cysteine substitution may form a disulphide bridge or bond (i.e., a linker) with a corresponding cysteine residue on a counterpart TCR beta chain, such as those described below, to assist in stabilising a TCR molecule derived therefrom.

It will be appreciated that the TCR alpha chain of the present invention may be a hybrid TCR alpha chain comprising sequences derived from more than one species, such as human and mouse. By way of example, it has surprisingly been found that exchanging the constant regions of human TCRs with the murine counterpart may improve function as well as expression levels on human T cells (see, e.g., Sommermeyer and Uckert, J Immunol, 2010, which is incorporated by reference herein). The TCR may therefore comprise human-derived variable regions and murine-derived constant regions.

Accordingly, in particular embodiments, the isolated alpha chain comprises one or more amino acid substitutions at positions 90, 91, 92 and/or 93 of a constant region thereof. In particular embodiments, the isolated alpha chain comprises:

(a) a P to S substitution at position 90;

(b) an E to D substitution at position 91;

(c) a S to V substitution at position 92; and/or (d) a S to P substitution at position 93.

In another aspect, the invention provides an isolated beta chain of a TCR or a fragment thereof, comprising at least one CDR amino acid sequence according to any one of SEQ ID NOS:412-492 and/or Tables 2-7 or an amino acid sequence at least 70% identical thereto.

In some embodiments, the isolated beta chain or fragment thereof further comprises one or more further CDR amino acid sequences (e.g., CDR1 and/or CDR2 amino acid sequences) according to any one of SEQ ID NOS:88-168 and 250-330 and/or Tables 2-7 or an amino acid sequence at least 70% identical thereto.

In particular embodiments, the isolated beta chain of the present aspect comprises, consists essentially of, or consists of an amino acid sequence according to any one of SEQ ID NOS:736-816 and/or FIGS. 94 to 99, or an amino acid sequence at least 70% identical thereto.

In one embodiment, the isolated beta chain comprises a cysteine residue, such as at position 57 of a constant region thereof. Again, it will be appreciated that such a cysteine substitution may form a disulphide bridge or bond (i.e., a linker) with a corresponding cysteine residue on a counterpart TCR alpha chain.

Similar to that for the TCR alpha chain above, the TCR beta chain of the present invention may also be a hybrid TCR beta chain comprising sequences derived from more than one species, such as human and mouse. By way of example, the isolated beta chain may comprise one or more amino acid substitutions at positions 18, 22, 133, 136 and/or 139 of a constant region thereof. In particular embodiments, the isolated beta chain comprises:

(a) an E to K substitution at position 18;

(b) a S to A substitution at position 22;

(c) a F to I substitution at position 133;

(d) a V to A substitution at position 136; and/or (e) a Q to H substitution at position 139.

In another aspect, the invention provides an isolated TCR or TCR fragment for binding an antigen derived from an Epstein Barr Virus (EBV), the TCR or TCR fragment comprising:

(i) an isolated alpha chain or fragment thereof according to the first mentioned aspect; and/or (ii) an isolated beta chain or fragment thereof according to the second mentioned aspect.

In view of the foregoing, the term "T-cell receptor" is used herein in a conventional manner to mean a molecule capable of recognising a peptide when presented by an MHC or HLA molecule. The molecule may be a heterodimer of two chains alpha (α) and beta (β) (or optionally gamma (γ) and delta (δ)) or it may be a single chain TCR construct.

In particular embodiments the antigen is derived, at least in part, from a latent membrane protein 1 (LMP-1) protein and/or a latent membrane protein 2 (LMP-2) protein (inclusive of fragments thereof) of EBV. In this regard, the TCR or TCR fragment may selectively bind to one or more epitopes or antigenic determinants derived from LMP-1 and/or LMP-2 (i.e., demonstrates antigenic specificity) when presented by a MHC or HLA molecule. Accordingly, the TCR of the present invention may recognize a full or partial amino acid sequence of LMP-1 and/or LMP 2 of EBV (e.g., SEQ ID NOs: 1-6).

The phrase "antigenic specificity," as used herein, means that the TCR (including functional portions and functional variants thereof) can specifically bind to and immunologically recognize one or more EBV antigens, such as those in SEQ ID NOS:1-6, with high avidity.

In certain embodiments, the alpha chain and beta chain of the T-cell receptor of the present aspect can be joined by a linker, such as those known in the art. By way of example, the linker can join the alpha and beta chains of the TCR of the invention by way of a disulphide bridge or bond.

Particular embodiments of isolated alpha chain, isolated beta chain and isolated TCR proteins comprise amino acid sequences set forth in SEQ ID NOS:655-816, and as shown in FIGS. 94 to 99, or an amino acid sequence at least 70% identical thereto.

In some embodiments, the TCR of the present aspect is or comprises a soluble TCR. It will be appreciated that soluble TCRs can be conjugated to immunostimulatory peptides and/or proteins, and/or moieties such as, but not limited, to CD3 agonists (e.g., anti-CD3 antibodies). The CD3 antigen is present on mature human T-cells, thymocytes, and a subset of natural killer cells. It can be associated with the TCR so as to facilitate signal transduction of the TCR. Antibodies specific for the human CD3 antigen are well known in the art (see, e.g., PCT International Patent Application Publication No. WO 2004/106380; U.S. Patent Application Publication No. 2004/0202657; U.S. Pat. Nos. 6,750,325; 6,706,265; Great Britain Patent Publication GB 224931 OA; Clark et al., 1988; U.S. Pat. No. 5,968,509; U.S. Patent Application Publication No. 2009/0117102).

Suitably, the soluble TCR may be included in one or more bi-specific immunotherapeutic agents such as ImmTACs (Immune mobilising TCRs against cancer) (Liddy, et al. (2012) Nat Med 18: 980-987) or BiTEs (Bispecific T-cell engaging antibodies) (Baeuerle, et al. (2009). Curr Opin Mol Ther 11 (1): 22-30). ImmTACs represent bifunctional proteins that combine affinity monoclonal T-cell receptor (mTCR) targeting with a therapeutic mechanism of action (e.g., an anti-CD3 scFv).

By "protein" is meant an amino acid polymer. The amino acids may be natural or non-natural amino acids, D- or L-amino acids as are well understood in the art.

The term "protein" includes and encompasses "peptide", which is typically used to describe a protein having no more than fifty (50) amino acids and "polypeptide", which is typically used to describe a protein having more than fifty (50) amino acids.

The invention also provides variants of the isolated alpha and beta chains and TCR proteins described herein.

As used herein, a protein "variant" shares a definable nucleotide or amino acid sequence relationship with an isolated protein or fragment disclosed herein. Preferably, protein variants share at least 25%, 30%, 35%, 40%, 45%, 50% or more preferably at least 55%, 60% or 65% or even more preferably 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity with an amino acid sequence of the invention, such as the amino acid sequence set forth in any one of SEQ ID NOS:7-492, 655-816, Tables 2-7 and FIGS. 94-99.

The "variant" proteins or fragments disclosed herein have one or more amino acids deleted or substituted by different amino acids. It is well understood in the art that some amino acids may be substituted or deleted without changing the activity of the immunogenic fragment and/or protein (conservative substitutions). For instance, the conservative amino acid substitution can be an acidic amino acid substituted for another acidic amino acid (e.g., Asp or Glu), an amino acid with a nonpolar side chain substituted for another amino acid with a nonpolar side chain (e.g., Ala, Gly, Val, Ile, Leu, Met, Phe, Pro, Trp, Val, etc.), a basic amino acid substituted for another basic amino acid (Lys, Arg, etc.), an amino acid with a polar side chain substituted for another amino acid with a polar side chain (Asn, Cys, Gln, Ser, Thr, Tyr, etc.), etc. Preferably, any amino acid changes should maintain or improve the capacity of the variants, such as functional variants, described herein to bind MHC or HLA molecules and/or an antigen presented thereby when compared to the parent or wildtype TCR, polypeptide, or protein.

The term "variant" also includes isolated proteins or fragments thereof disclosed herein, produced from, or comprising amino acid sequences of, naturally occurring (e.g., allelic) variants, orthologs (e.g., from a species other than humans) and synthetic variants, such as produced in vitro using mutagenesis techniques.

Variants may retain the biological activity of a corresponding wild type protein (e.g., allelic variants, paralogs and orthologs) or may lack, or have a substantially reduced, biological activity compared to a corresponding wild type protein.

Terms used generally herein to describe sequence relationships between respective proteins and nucleic acids include "comparison window", "sequence identity", "percentage of sequence identity" and "substantial identity". Because respective nucleic acids/proteins may each comprise (1) only one or more portions of a complete nucleic acid/protein sequence that are shared by the nucleic acids/proteins, and (2) one or more portions which are divergent between the nucleic acids/proteins, sequence comparisons are typically performed by comparing sequences over a "comparison window" to identify and compare local regions of sequence similarity. A "comparison window" refers to a conceptual segment of typically 6, 9 or 12 contiguous residues that is compared to a reference sequence. The comparison window may comprise additions or deletions (i.e., gaps) of about 20% or less as compared to the reference sequence for optimal alignment of the respective sequences. Optimal alignment of sequences for aligning a comparison window may be conducted by computerised implementations of algorithms (Geneworks program by Intelligenetics; GAP, BESTFIT, FASTA, and TFASTA in the Wisconsin Genetics Software Package Release 7.0, Genetics Computer Group, 575 Science Drive Madison, WI, USA, incorporated herein by reference) or by inspection and the best alignment (i.e. resulting in the highest percentage homology over the comparison window) generated by any of the various methods selected. Reference also may be made to the BLAST family of programs as for example disclosed by Altschul et al., 1997, Nucl. Acids Res. 25 3389, which is incorporated herein by reference. A detailed discussion of sequence analysis can be found in Unit 19.3 of CURRENT PROTOCOLS IN MOLECULAR BIOLOGY Eds. Ausubel et al. (John Wiley & Sons Inc NY, 1995-1999).

The term "sequence identity" is used herein in its broadest sense to include the number of exact nucleotide or amino acid matches having regard to an appropriate alignment using a standard algorithm, having regard to the extent that sequences are identical over a window of comparison. Thus, a "percentage of sequence identity" is calculated by comparing two optimally aligned sequences over the window of comparison, determining the number of positions at which the identical nucleic acid base (e.g., A, T, C, G, I) occurs in both sequences to yield the number of matched positions, dividing the number of matched positions by the total number of positions in the window of comparison (i.e., the window size), and multiplying the result by 100 to yield the percentage of sequence identity. For example, "sequence identity" may be understood to mean the "match percentage" calculated by the DNASIS computer program (Version 2.5 for windows; available from Hitachi Software engineering Co., Ltd., South San Francisco, California, USA).

Derivatives of the alpha chain, beta chain and TCR proteins described herein are also provided.

As used herein, "derivative" proteins have been altered, for example by conjugation or complexing with other chemical moieties, by post-translational modification (e.g. phosphorylation, acetylation and the like), modification of glycosylation (e.g. adding, removing or altering glycosylation) and/or inclusion of additional amino acid sequences as would be understood in the art.

Additional amino acid sequences may include fusion partner amino acid sequences which create a fusion protein. By way of example, fusion partner amino acid sequences may assist in detection and/or purification of the isolated fusion protein. Non-limiting examples include metal-binding (e.g. polyhistidine) fusion partners, maltose binding protein (MBP), Protein A, glutathione S-transferase (GST), fluorescent protein sequences (e.g. GFP), epitope tags such as myc, FLAG and haemagglutinin tags.

Other derivatives contemplated by the invention include, but are not limited to, modification to side chains, incorporation of unnatural amino acids and/or their derivatives during peptide, or protein synthesis and the use of crosslinkers and other methods which impose conformational constraints on the immunogenic proteins, fragments and variants of the invention.

In this regard, the skilled person is referred to Chapter 15 of CURRENT PROTOCOLS IN PROTEIN SCIENCE, Eds. Coligan et al. (John Wiley & Sons NY 1995-2008) for more extensive methodology relating to chemical modification of proteins.

The isolated proteins, variants, fragments and/or derivatives of the present invention may be produced by any means known in the art, including but not limited to, chemical synthesis, recombinant DNA technology and proteolytic cleavage to produce peptide fragments.

Chemical synthesis is inclusive of solid phase and solution phase synthesis. Such methods are well known in the art, although reference is made to examples of chemical synthesis techniques as provided in Chapter 9 of SYNTHETIC VACCINES Ed. Nicholson (Blackwell Scientific Publications) and Chapter 15 of CURRENT PROTOCOLS IN PROTEIN SCIENCE Eds. Coligan et al., (John Wiley & Sons, Inc. NY USA 1995-2008). In this regard, reference is also made to International Publication WO 99/02550 and International Publication WO 97/45444.

In one preferred embodiment, the isolated alpha chain, the isolated beta chain and/or the isolated TCR proteins of the present invention are recombinant proteins.

Recombinant proteins may be conveniently prepared by a person skilled in the art using standard protocols as for example described in Sambrook et al., MOLECULAR CLONING. A Laboratory Manual (Cold Spring Harbor Press, 1989), in particular Sections 16 and 17; CURRENT PROTOCOLS IN MOLECULAR BIOLOGY Eds. Ausubel et al., (John Wiley & Sons, Inc. NY USA 1995-2008), in particular Chapters 10 and 16; and CURRENT PROTOCOLS IN PROTEIN SCIENCE Eds. Coligan et al., (John Wiley & Sons, Inc. NY USA 1995-2008), in particular Chapters 1, 5 and 6.

In some aspects, the invention provides fragments of the isolated alpha chain, the isolated beta chain and the TCR proteins of the invention.

A "fragment" is a segment, domain, portion or region of a protein, which constitutes less than 100% of the amino acid sequence of the protein.

In general, fragments may comprise up to 5, 10, 20, 30, 40, 50, 60, 70, 80, 90, 100, 110, 120, 130, 140, 150, 200, 250, 300, 350, 400, 450, 550 or up to about 600 amino acids of an amino acid sequence.

Fragments of the invention can be produced by those methods hereinbefore described. Alternatively, fragments can be produced, for example, by digestion of an alpha chain, beta chain or TCR protein with proteinases such as endoLys-C, endoArg-C, endoGlu-C and V8-protease. The digested fragments can be purified by chromatographic techniques as are well known in the art.

Particular embodiments of the invention provide an immunogenic fragment of the isolated alpha chain, the isolated beta chain and/or the TCR of the invention. By "immunogenic" is meant capable of eliciting an immune response upon administration to an animal, such as a human, mouse or rabbit. The immune response may include the production, activation or stimulation of the innate and/or adaptive arms of the immune system inclusive of immune cells such as B and/or T lymphocytes, NK cells, granulocytes, macrophages and dendritic cells and/or molecules such as antibodies, cytokines and chemokines, although without limitation thereto.

Accordingly, such immunogenic fragments may be suitable for the production of antibodies of the invention as hereinafter described. Preferably, the immunogenic fragment comprises the entire CDR3 sequence of any one of SEQ ID NOS:331-492 or those listed in Tables 2 to 7. The invention also provides an isolated protein comprising one or a plurality of the aforementioned immunogenic fragments, such as in the form of a "polytope" protein. For example, said immunogenic fragments may be present singly or as repeats, which also includes tandemly repeated fragments. Heterologous amino acid sequences (e.g. "spacer" amino acids) may also be included between one or a plurality of the immunogenic fragments present in said isolated protein.

In yet a further embodiment, the invention of the present aspect provides an isolated protein or peptide that consists of: (i) a segment, domain, portion or region (e.g., a CDR) of one or more of the isolated alpha chain, the isolated beta chain and/or the TCR proteins described herein, such as those according to SEQ ID NOS:7-492, 655-816, Tables 2-7 and FIGS. 94-99, and inclusive of fragments, variants or derivatives thereof; and (ii) optionally one or more additional amino acid sequences. In this regard, the additional amino acid sequences are preferably heterologous amino acid sequences that can be at the N- and/or C-termini of the recited amino acid sequence of the aforementioned proteins, although without limitation thereto.

In another aspect, the present invention contemplates isolated nucleic acids that encode, or are complementary to a nucleic acid sequence which encodes, the isolated proteins (e.g., alpha chain, beta chain and TCR proteins, inclusive of fragments, variants and derivatives thereof) disclosed herein.

Nucleotide sequences encoding the isolated proteins, isolated immunogenic fragments, variants, derivatives and polytopes of the invention may be readily deduced from one or more of the complete nucleic acid sequences provided herein (see, e.g., SEQ ID NOs:493-654), although without limitation thereto.

This aspect also includes fragments, variants and derivatives of said isolated nucleic acid, such as those herein before described.

The term "nucleic acid" as used herein designates single- or double-stranded DNA and RNA. DNA includes genomic DNA and cDNA. RNA includes mRNA, RNA, RNAi, siRNA, cRNA and autocatalytic RNA. Nucleic acids may also be DNA-RNA hybrids. A nucleic acid comprises a nucleotide sequence which typically includes nucleotides that comprise an A, G, C, T or U base. However, nucleotide sequences may include other bases such as inosine, methylcytosine, methylinosine, methyladenosine and/or thiouridine, although without limitation thereto.

Accordingly, in particular embodiments, the isolated nucleic acid is cDNA.

A "polynucleotide" is a nucleic acid having eighty (80) or more contiguous nucleotides, while an "oligonucleotide" has less than eighty (80) contiguous nucleotides.

A "probe" may be a single or double-stranded oligonucleotide or polynucleotide, suitably labelled for the purpose of detecting complementary sequences in Northern or Southern blotting, for example.

A "primer" is usually a single-stranded oligonucleotide, preferably having 15-50 contiguous nucleotides, which is capable of annealing to a complementary nucleic acid "template" and being extended in a template-dependent fashion by the action of a DNA polymerase such as Taq polymerase, RNA-dependent DNA polymerase or Sequenase™.

Another particular aspect of the invention provides a variant of an isolated nucleic acid that encodes an isolated immunogenic fragment or protein of the invention.

In one embodiment, nucleic acid variants encode a variant of an isolated protein of the invention.

In another embodiment, nucleic acid variants share at least 40%, 45%, 50%, 55%, 60% or 65%, 66%, 67%, 68%, 69%, preferably at least 70%, 71%, 72%, 73%, 74% or 75%, more preferably at least 80%, 81%, 82%, 83%, 84%, or 85%, and even more preferably at least 90%, 91%, 92%, 93%, 94%, 95%, 96%, 97%, 98% or 99% nucleotide sequence identity with an isolated nucleic acid of the invention.

In one particular embodiment, the isolated nucleic acid of the present aspect consists of: (a) a nucleic acid that: (i) encodes a segment, domain, portion or region of an isolated alpha chain protein, an isolated beta chain protein and/or an isolated TCR protein described herein, such as those according to SEQ ID NOS:7-492, 655-816, Tables 2-7 and FIGS. 94-99, and inclusive of variants or derivatives thereof; or (ii) comprises, consists essentially of, or consists of a nucleic acid sequence according to any one of SEQ ID NOs:493-654 or a nucleic acid sequence at least 70% identical thereto; and (b) optionally one or more additional nucleic acid sequences. In this regard, the additional nucleic acid sequences are preferably heterologous nucleic acid sequences that can be at the 5' (5-prime) and/or 3' (3-prime) ends of the isolated nucleic acid sequence, although without limitation thereto.

The present invention also contemplates nucleic acids that have been modified such as by taking advantage, of codon sequence redundancy. In a more particular example, codon usage may be modified to optimize expression of a nucleic acid in a particular organism or cell type.

The invention further provides use of modified purines (for example, inosine, methylinosine and methyladenosine) and modified pyrimidines (for example, thiouridine and methylcytosine) in nucleic acids of the invention.

It will be well appreciated by a person of skill in the art that the isolated nucleic acids of the invention can be conveniently prepared using standard protocols such as those described in Chapter 2 and Chapter 3 of CURRENT PROTOCOLS IN MOLECULAR BIOLOGY (Eds. Ausubel et al. John Wiley & Sons NY, 1995-2008).

In yet another embodiment, complementary nucleic acids hybridise to nucleic acids of the invention under high stringency conditions.

"Hybridise and Hybridisation" is used herein to denote the pairing of at least partly complementary nucleotide sequences to produce a DNA-DNA, RNA-RNA or DNA-RNA hybrid. Hybrid sequences comprising complementary nucleotide sequences occur through base-pairing.

"Stringency" as used herein, refers to temperature and ionic strength conditions, and presence or absence of certain organic solvents and/or detergents during hybridisation. The higher the stringency, the higher will be the required level of complementarity between hybridizing nucleotide sequences.

"Stringent conditions" designates those conditions under which only nucleic acid having a high frequency of complementary bases will hybridize.

Stringent conditions are well-known in the art, such as described in Chapters 2.9 and 2.10 of Ausubel et al., supra, which are herein incorporated by reference. A skilled addressee will also recognize that various factors can be manipulated to optimize the specificity of the hybridization. Optimization of the stringency of the final washes can serve to ensure a high degree of hybridization.

Complementary nucleotide sequences may be identified by blotting techniques that include a step whereby nucleotides are immobilized on a matrix (preferably a synthetic membrane such as nitrocellulose), a hybridization step, and a detection step, typically using a labelled probe or other complementary nucleic acid. Southern blotting is used to identify a complementary DNA sequence; Northern blotting is used to identify a complementary RNA sequence. Dot blotting and slot blotting can be used to identify complementary DNA/DNA, DNA/RNA or RNA/RNA polynucleotide sequences. Such techniques are well known by those skilled in the art, and have been described in Ausubel et al., supra, at pages 2.9.1 through 2.9.20. According to such methods, Southern blotting involves separating DNA molecules according to size by gel electrophoresis, transferring the size-separated DNA to a synthetic membrane, and hybridizing the membrane bound DNA to a complementary nucleotide sequence. An alternative blotting step is used when identifying complementary nucleic acids in a cDNA or genomic DNA library, such as through the process of plaque or colony hybridization. Other typical examples of this procedure are described in Chapters 8-12 of Sambrook et al., MOLECULAR CLONING. A Laboratory Manual (Cold Spring Harbor Press, 1989).

Methods for detecting labelled nucleic acids hybridized to an immobilized nucleic acid are well known to practitioners in the art. Such methods include autoradiography, chemiluminescent, fluorescent and colorimetric detection.

Nucleic acids may also be isolated, detected and/or subjected to recombinant DNA technology using nucleic acid sequence amplification techniques.

Suitable nucleic acid amplification techniques covering both thermal and isothermal methods are well known to the skilled addressee, and include polymerase chain reaction (PCR); strand displacement amplification (SDA); rolling circle replication (RCR); nucleic acid sequence-based amplification (NASBA), Q-β replicase amplification, recombinase polymerase amplification (RPA) and helicase-dependent amplification, although without limitation thereto.

As used herein, an "amplification product" refers to a nucleic acid product generated by nucleic acid amplification.

Nucleic acid amplification techniques may include particular quantitative and semi-quantitative techniques such as qPCR, real-time PCR and competitive PCR, as are well known in the art.

In another aspect, the invention provides a genetic construct comprising: (i) the isolated nucleic acid described herein; or (ii) an isolated nucleic acid comprising a nucleotide sequence complementary thereto. Preferably, the isolated nucleic acid is operably linked or connected to one or more regulatory sequences in an expression vector.

Suitably, the genetic construct is in the form of, or comprises genetic components of, a plasmid, bacteriophage, a cosmid, a yeast or bacterial artificial chromosome as are well understood in the art. Genetic constructs may be suitable for maintenance and propagation of the isolated nucleic acid in bacteria or other host cells, for manipulation by recombinant DNA technology and/or expression of the nucleic acid or an encoded protein of the invention.

For the purposes of host cell expression, the genetic construct can be an expression construct. Suitably, the expression construct comprises the nucleic acid of the invention operably linked to one or more additional sequences in an expression vector. An "expression vector" may be either a self-replicating extra-chromosomal vector such as a plasmid, or a vector that integrates into a host genome. In this regard, the vector may be capable of transferring a nucleotide of the invention to a host cell, such as a T-cell, such that the cell expresses an EBV-specific TCR. The vector should ideally be capable of sustained high-level expression in T cells.

By "operably linked" is meant that said additional nucleotide sequence(s) is/are positioned relative to the nucleic acid of the invention preferably to initiate, regulate or otherwise control transcription.

Regulatory nucleotide sequences will generally be appropriate for the host cell used for expression. Numerous types of appropriate expression vectors and suitable regulatory sequences are known in the art for a variety of host cells.

Typically, said one or more regulatory nucleotide sequences may include, but are not limited to, promoter sequences, leader or signal sequences, ribosomal binding sites, transcriptional start and termination sequences, translational start and termination sequences, and enhancer or activator sequences.

Constitutive or inducible promoters as known in the art are contemplated by the invention.

In particular embodiments, the expression construct is or comprises one or more viral delivery systems, such as an adenovirus vector, an adeno-associated viral (AAV) vector, a herpes viral vector, a retroviral vector, a lentiviral vector and a baculoviral vector.

In a further aspect, the invention provides a host cell transformed with a nucleic acid molecule or a genetic construct described herein.

Suitable host cells for expression may be prokaryotic or eukaryotic. For example, suitable host cells may include but are not limited to mammalian cells (e.g. HeLa, HEK293T, Jurkat cells), yeast cells (e.g. *Saccharomyces cerevisiae*), insect cells (e.g. SJ9, *Trichoplusia ni*) utilized with or without a baculovirus expression system, plant cells (e.g. *Chlamydomonas reinhardtii, Phaeodactylum tricornutum*) or bacterial cells, such as *E. coli*. Introduction of genetic constructs into host cells (whether prokaryotic or eukaryotic) is well known in the art, as for example described in CURRENT PROTOCOLS IN MOLECULAR BIOLOGY Eds. Ausubel et al., (John Wiley & Sons, Inc. 1995-2009), in particular Chapters 9 and 16.

In particular embodiments, the host cell is or comprises a T cell. It is envisaged that the T cell can be any T cell, such as a cultured T cell, e.g., a primary T cell, or a T cell from a cultured T cell line, e.g., Jurkat, SupT1, etc., or a T cell obtained from a mammal. If obtained from a mammal, the T cell can be obtained from numerous sources, including but not limited to blood, bone marrow, lymph node, the thymus, or other tissues or fluids. T cells can also be enriched for or purified. Preferably, the T cell is a human T cell. The T cell can be any type of T cell and can be of any developmental stage, including but not limited to, $CD4^+/CD8^+$ double positive T cells, $CD4^+$ helper T cells, e.g., $Th_1$ and $Th_2$ cells, $CD4^+$ T cells, $CD8^+$ T cells (e.g., cytotoxic T cells), tumor infiltrating lymphocytes (TILs), memory T cells (e.g., central memory T cells and effector memory T cells), naïve T cells, and the like.

Suitably, the T-cell is or comprises a CD4+ helper T cell and/or a CD8+ cytotoxic T cell. In this regard, the T-cell of the present aspect may be in a mixed population of CD4+ helper T cell/CD8+ cytotoxic T cells. It will further be appreciated that expression of the alpha chain, the beta chain and/or TCR proteins of the present invention by regulatory T cells (e.g., CD4+25+ regulatory T-cells) may be undesirable as they can suppress the anti-viral activity of cytotoxic and helper T cells that also express such proteins.

Advantageously, the isolated alpha chain, the isolated beta chain and/or the isolated TCR of the present invention can be utilised in TCR gene transfer, an approach that is rapid, reliable and capable of generating large quantities of T cells (>$10^8$-$10^{10}$ cells/patient) with specificity to, for example, one or more of those EBV antigens described herein (e.g., LMP-1 and/or LMP-2), inclusive of those associated with EBV positive cancers, regardless of the patient's pre-existing immune repertoire. For example, retroviral transductions may require only 48 hours of culture with pre-activated T-cells. Further, large numbers of autologous T-cells can be obtained from leukaphoresis of a blood sample from a subject. Thus, it may be possible to engineer $10^8$-$10^9$ transformed or transfected T-cells for infusion in a few days.

Accordingly, a host cell (e.g., T cell) of the present invention can be used in the treatment of an EBV-associated disease, disorder or condition by means of adoptive transfer. To this end, T cells are typically isolated from a biological sample taken from a subject, inclusive of donor subjects, for use in the adoptive transfer of genetically modified cells.

Preferably, the T-cells transduced or transformed with the isolated alpha chain, the isolated beta chain and/or the isolated TCR of the present invention (such as those proteins set forth in SEQ ID NOs:7-492, 655-816, Tables 2-7 and FIGS. 94-99) contain a mixture of naive, central memory and effector memory cells.

Also provided by the invention is a population of cells comprising at least one host cell described herein. The population of cells can be a heterogeneous population comprising the host cell comprising any of the recombinant expression vectors described, in addition to at least one other cell, e.g., a host cell (e.g., a T cell), which does not comprise any of the recombinant expression vectors, or a cell other than a T cell, e.g., a B cell, a macrophage, a neutrophil, an erythrocyte, a hepatocyte, an endothelial cell, an epithelial cell, a muscle cell, a brain cell, etc. Alternatively, the population of cells can be a substantially homogeneous population, in which the population comprises mainly of host cells (e.g., consisting essentially of) comprising the recombinant expression vector. The population also can be a clonal population of cells, in which all cells of the population are clones of a single host cell comprising a recombinant expression vector, such that all cells of the population comprise the recombinant expression vector. In one embodiment of the invention, the population of cells is a clonal population comprising host cells comprising a recombinant expression vector as described herein.

In one embodiment, the number of cells in the population may be rapidly expanded. Expansion of the numbers of T cells can be accomplished by any of a number of methods as are known in the art as described in, for example, U.S. Pat. Nos. 8,034,334; 8,383,099; U.S. Patent Application Publication No. 2012/0244133; Dudley et al., *J. Immunother.*, 26:332-42 (2003); and Riddell et al., *J Immunol. Methods,* 128:189-201 (1990).

In alternative embodiments, the host cell is, or is derived from, a stem cell, such as a haemopoietic stem cell (HSC). To this end, the host cell may therefore be a gene-modified stem cell, which, upon differentiation, produces a T-cell expressing an alpha chain, a beta chain and/or a TCR of the invention.

In yet another aspect, the invention provides a method of producing an isolated protein described herein, comprising; (i) culturing the previously transformed host cell hereinbefore described; and (ii) isolating said protein from said host cell cultured in step (i).

The recombinant protein may be conveniently prepared by a person skilled in the art using standard protocols as for example described in Sambrook, et al., MOLECULAR CLONING. A Laboratory Manual (Cold Spring Harbor Press, 1989), in particular Sections 16 and 17; CURRENT PROTOCOLS IN MOLECULAR BIOLOGY Eds. Ausubel et al., (John Wiley & Sons, Inc. 1995-2009), in particular Chapters 10 and 16; and CURRENT PROTOCOLS IN PROTEIN SCIENCE Eds. Coligan et al., (John Wiley & Sons, Inc. 1995-2009), in particular Chapters 1, 5 and 6.

In a further aspect, the invention provides an antibody or antibody fragment which binds and/or is raised against an isolated alpha chain, an isolated beta chain and/or an isolated TCR described herein, inclusive of fragments, variants and derivatives thereof.

As generally used herein, an "antibody" is or comprises an immunoglobulin protein. The term "immunoglobulin" includes any antigen-binding protein product of a mammalian immunoglobulin gene complex, including immunoglobulin isotypes IgA, IgD, IgM, IgG and IgE and antigen-binding fragments thereof. Included in the term "immunoglobulin" are immunoglobulins that are chimeric or humanised or otherwise comprise altered or variant amino acid residues, sequences and/or glycosylation, whether naturally occurring or produced by human intervention (e.g. by recombinant DNA technology).

Suitably, said antibody or antibody fragment specifically binds said isolated protein. Preferably, the antibody or antibody fragment specifically or selectively binds or recognizes a full or partial amino acid sequence of a CDR3 of an alpha chain and/or a beta chain described herein (e.g., SEQ ID NOs: 331-492). In this regard, the antibody or antibody fragment of the present aspect may be suitable for use in methods of detecting or isolating a T-cell that expresses the TCR having that particular CDR3 in a biological sample from a subject, as hereinafter described. It will be appreciated that the detected or isolated T-cell may be suitable for subsequent use in cellular immunotherapy of an EBV-associated disease, disorder or condition.

Antibodies may be polyclonal or monoclonal, native or recombinant. Well-known protocols applicable to antibody production, purification and use may be found, for example, in Chapter 2 of Coligan et al., CURRENT PROTOCOLS IN IMMUNOLOGY (John Wiley & Sons NY, 1991-1994) and Harlow, E. & Lane, D. *Antibodies: A Laboratory Manual*, Cold Spring Harbor, Cold Spring Harbor Laboratory, 1988, which are both herein incorporated by reference.

Generally, antibodies of the invention bind to or conjugate with an isolated protein, fragment, variant, or derivative of the invention. For example, the antibodies may be polyclonal antibodies. Such antibodies may be prepared for example by injecting an isolated protein, fragment, variant or derivative of the invention into a production species, which may include mice or rabbits, to obtain polyclonal antisera. Methods of producing polyclonal antibodies are well known to those skilled in the art. Exemplary protocols which may be used are described for example in Coligan et al., CURRENT PROTOCOLS IN IMMUNOLOGY, supra, and in Harlow & Lane, 1988, supra.

Monoclonal antibodies may be produced using the standard method as for example, described in an article by Kohler & Milstein, 1975, Nature 256, 495, which is herein incorporated by reference, or by more recent modifications thereof as for example, described in Coligan et al., CURRENT PROTOCOLS IN IMMUNOLOGY, supra by immortalizing spleen or other antibody producing cells derived from a production species which has been inoculated with one or more of the isolated proteins, fragments, variants or derivatives of the invention.

The invention also includes within its scope antibody fragments, such as Fc, Fab or F(ab)2 fragments of the polyclonal or monoclonal antibodies referred to above. Alternatively, the antibodies may comprise single chain Fv antibodies (scFvs) against the peptides of the invention. Such scFvs may be prepared, for example, in accordance with the methods described respectively in U.S. Pat. No. 5,091,513, European Patent No 239,400 or the article by Winter & Milstein, 1991, Nature 349:293, which are incorporated herein by reference. The invention is also contemplated to include multivalent recombinant antibody fragments, so-called diabodies, triabodies and/or tetrabodies, comprising a plurality of scFvs, as well as dimerisation-activated demibodies (e.g., WO/2007/062466). By way of example, such antibodies may be prepared in accordance with the methods described in Holliger et al., 1993 Proc Natl Acad Sci USA 90:6444-6448; or in Kipriyanov, 2009 Methods Mol Biol 562:177-93 and herein incorporated by reference in their entirety.

Antibodies and antibody fragments of the invention may be particularly suitable for affinity chromatography purification of the isolated proteins described herein, such as those purified from a biological sample of a subject donor or those recombinantly made. For example reference may be made to affinity chromatographic procedures described in Chapter 9.5 of Coligan et al., CURRENT PROTOCOLS IN IMMUNOLOGY, supra.

In one further aspect, the invention provides a composition comprising:

(i) an isolated alpha chain or fragment, variant or derivative thereof described herein;
(ii) an isolated beta chain or fragment, variant or derivative thereof described herein;
(iii) an isolated TCR or TCR fragment, variant or derivative described herein;
(iv) an isolated nucleic acid or fragment, variant or derivative described herein;
(v) a genetic construct described herein; and/or
(vi) a host cell described herein;
and optionally a pharmaceutically acceptable carrier, diluent or excipient.

By "pharmaceutically-acceptable carrier, diluent or excipient" is meant a solid or liquid filler, diluent or encapsulating substance that may be safely used in systemic administration. Depending upon the particular route of administration, a variety of carriers, well known in the art may be used. These carriers may be selected from a group including sugars, starches, cellulose and its derivatives, malt, gelatine, talc, calcium sulfate, vegetable oils, synthetic oils, polyols, alginic acid, phosphate buffered solutions, emulsifiers, isotonic saline and salts such as mineral acid salts including hydrochlorides, bromides and sulfates, organic acids such as acetates, propionates and malonates and pyrogen-free water.

A useful reference describing pharmaceutically acceptable carriers, diluents and excipients is Remington's Pharmaceutical Sciences (Mack Publishing Co. N.J. USA, 1991) which is incorporated herein by reference.

In particular aspects, the invention provides a method of treating or preventing an EBV-associated disease, disorder or condition in a subject, said method including the step of administering a therapeutically effective amount of an isolated alpha chain or fragment, variant or derivative thereof described herein, an isolated beta chain or fragment, variant or derivative thereof described herein, an isolated TCR or TCR fragment, variant or derivative described herein, an isolated nucleic acid or fragment, variant or derivative described herein, a genetic construct described herein, a host cell described herein, and/or a composition described herein to the subject to thereby treat or prevent the EBV-associated disease, disorder or condition in the subject.

As used herein, "treating" (or "treat" or "treatment") refers to a therapeutic intervention that ameliorates a sign or symptom of an EBV-associated disease, disorder or condition after it has begun to develop. The term "ameliorating," in respect of a EBV-associated disease, disorder or condition, refers to any observable beneficial effect of the treatment. Treatment need not be absolute to be beneficial to the subject. The beneficial effect can be determined using any methods or standards known to the ordinarily skilled artisan.

As used herein, "preventing" (or "prevent" or "prevention") refers to a course of action initiated prior to the onset of a symptom, aspect, or characteristic of an EBV-associated disease, disorder or condition, so as to prevent or reduce the symptom, aspect, or characteristic. It is to be understood that such preventing need not be absolute to be beneficial to a subject. A "prophylactic" treatment is a treatment administered to a subject who does not exhibit signs of an EBV-associated disease, disorder or condition, or exhibits only early signs for the purpose of decreasing the risk of developing a symptom, aspect, or characteristic of an EBV-associated disease, disorder or condition.

In the context of the present invention, by "EBV-associated disease, disorder or condition" is meant any clinical pathology resulting from infection by an Epstein Barr virus. To this end, EBV-associated disease, disorder or condition can mean any disease caused, directly or indirectly, by EBV as well as diseases which predispose a patient to infection by EBV. Examples of diseases falling into the former category include infectious mononucleosis, nasopharyngeal carcinoma, and Burkitt's lymphoma. Diseases in the latter category (i.e., those which place the patient at risk of EBV infection) include acquired immune deficiency syndrome and, generally, any condition that causes a state of immunosuppression or decreased function of the immune system such as patients who receive organ transplants and certain cancer therapies. In one particular embodiment, the EBV-associated disease, disorder or condition suitably is or comprises multiple sclerosis.

In preferred embodiments, the EBV-associated disease, disorder or condition is or comprises an EBV-associated and/or -positive cancer. As used herein, and unless otherwise specified, the term "EBV-associated cancer" or "EBV-positive cancer" refers to a cancer that has been linked to the Epstein-Barr virus (EBV). In certain embodiments, EBV-positive cancers are cancers wherein greater than about 30%, greater than about 40%, greater than about 50%, greater than about 60%, greater than about 70%, or greater than about 80% contain or express the EBV virus. Suitably, the EBV-associated cancer is selected from the group consisting of nasopharyngeal carcinoma, NKT cell lymphoma, Hodgkin's lymphoma, post-transplant lymphoproliferative disease, Burkitt's lymphoma, Diffuse large B-cell lymphoma, gastric cancer, gliobastoma multiforme and any combination thereof.

As generally used herein, the terms "cancer", "tumour", "malignant" and "malignancy" refer to diseases or conditions, or to cells or tissues associated with the diseases or conditions, characterized by aberrant or abnormal cell proliferation, differentiation and/or migration often accompanied by an aberrant or abnormal molecular phenotype that includes one or more genetic mutations or other genetic changes associated with oncogenesis, expression of tumour markers, loss of tumour suppressor expression or activity and/or aberrant or abnormal cell surface marker expression.

Cancers may include any aggressive or potentially aggressive cancers, tumours or other malignancies such as listed in the NCI Cancer Index at http://www.cancer.gov/cancertopics/alphalist, including all major cancer forms such as sarcomas, carcinomas, lymphomas, leukaemias and blastomas, although without limitation thereto. These may include breast cancer, lung cancer inclusive of lung adenocarcinoma, cancers of the reproductive system inclusive of ovarian cancer, cervical cancer, uterine cancer and prostate cancer, cancers of the brain and nervous system, head and neck cancers, gastrointestinal cancers inclusive of colon cancer, colorectal cancer and gastric cancer, liver cancer, kidney cancer, skin cancers such as melanoma and skin carcinomas, blood cell cancers inclusive of lymphoid cancers and myelomonocytic cancers, cancers of the endocrine system such as pancreatic cancer and pituitary cancers, musculoskeletal cancers inclusive of bone and soft tissue cancers, although without limitation thereto. In particular embodiments, the cancer is a solid cancer or a leukaemia or liquid cancer. Suitably, the cancer expresses, such as overexpresses, one or more EBV antigens, such as those hereinbefore described.

By "administering" or "administration" is meant the introduction of an isolated protein, encoding nucleic acid, genetic construct, host cell or composition disclosed herein into an animal subject by a particular chosen route.

Any safe route of administration may be employed, inclusive of oral, rectal, parenteral, sublingual, buccal, intravenous, intra-articular, intra-muscular, intra-dermal, transdermal, subcutaneous, inhalational, intraocular, intraperitoneal and intracerebroventricular administration.

Dosage forms include tablets, dispersions, suspensions, injections, solutions, syrups, troches, capsules, nasal sprays, suppositories, aerosols, transdermal patches and the like. These dosage forms may also include injecting or implanting controlled releasing devices designed specifically for this purpose or other forms of implants modified to act additionally in this fashion. Controlled release of the therapeutic agent may be effected by coating the same, for example, with hydrophobic polymers including acrylic resins, waxes, higher aliphatic alcohols, polylactic and polyglycolic acids and certain cellulose derivatives such as hydroxypropylmethyl cellulose. In addition, the controlled release may be effected by using other polymer matrices, liposomes and/or microspheres.

Compositions of the present invention suitable for oral or parenteral administration may be presented as discrete units such as capsules, sachets, functional foods/feeds or tablets each containing a pre-determined amount of one or more therapeutic agents of the invention, as a powder or granules or as a solution or a suspension in an aqueous liquid, a non-aqueous liquid, an oil-in-water emulsion or a water-in-oil liquid emulsion. Such compositions may be prepared by any of the methods of pharmacy but all methods include the step of bringing into association one or more agents as described above with the carrier which constitutes one or more necessary ingredients. In general, the compositions are prepared by uniformly and intimately admixing the agents of the invention with liquid carriers or finely divided solid carriers or both, and then, if necessary, shaping the product into the desired presentation.

The above compositions may be administered in a manner compatible with the dosage formulation, and in such amount as is pharmaceutically-effective. The dose administered to a patient, in the context of the present invention, should be sufficient to effect a beneficial response in a patient over an appropriate period of time. The quantity of agent(s) to be administered may depend on the subject to be treated inclusive of the age, sex, weight and general health condition thereof, factors that will depend on the judgement of the practitioner.

One particular broad application of the present invention is the provision of methods of performing cellular or adoptive immunotherapy in a subject having an EBV-associated disease, disorder or condition, such as those hereinbefore described, said method including the step of administering a therapeutically effective amount of a host cell (e.g., T-cell) described herein and optionally a pharmaceutically acceptable carrier, diluent or excipient to the subject.

The terms "cellular immunotherapy" or "adoptive immunotherapy" denote the transfer of immunocompetent cells, such as T-cells, for the treatment of cancer or infectious diseases (see, e.g., June, C. H., ed., 2001, In: Cancer Chemotherapy and Biotherapy: Principles and Practice, Lippincott Williams & Wilkins, Baltimore; Vonderheide et al., 2003, Immun. Research 27:1-15). To this end, it will be understood that adoptive immunotherapy is a strategy typically aimed at replacing, repairing, or enhancing the biological function of a tissue or system, such as the immune system, by means of autologous or allogeneic cells, such as T-cells.

In particular embodiments, the EBV-associated disease, disorder or condition is or comprises a cancer, such as those hereinbefore provided.

In another aspect, the invention provides a method of detecting or isolating a T-cell in a biological sample from a subject, the method including the step of contacting the biological sample with an antibody or antibody fragment hereinbefore described for a time and under conditions sufficient to thereby detect or isolate said T-cell.

Preferably, the detected or isolated T-cell comprises an alpha chain, a beta chain and/or a T-cell receptor provided herein, such that the detected or isolated T-cell is preferably suitable for use in cellular immunotherapy of an EBV-associated disease, disorder or condition. In this regard, the T-cells may be autologous and/or allogeneic (i.e., derived or obtained from a donor, such as a genetically matched donor) cells.

In certain embodiments, the biological sample may be a pathology sample that comprises one or more fluids, cells, tissues, organs or organ samples, such as cancer cells and/or tissues, obtained from an animal. Non-limiting examples include blood, plasma, serum, lymphocytes, urine, faeces, amniotic fluid, cervical samples, cerebrospinal fluid, tissue biopsies, bone marrow, bronchoalveolar lavage fluid, sputum and skin.

In particular embodiments, the method of the present aspect further includes the step of obtaining the biological sample from the subject.

Suitably, the methods described herein are performed on a mammal.

In one embodiment, the mammal is a human.

While the principles described herein are based on methods of treatment for humans, this invention may also be extended to other mammals such as livestock (e.g. cattle, sheep), performance animals (e.g. racehorses) and domestic pets (e.g. dogs, cats), although without limitation thereto.

All computer programs, algorithms, patent and scientific literature referred to herein is incorporated herein by reference.

So that the invention may be readily understood and put into practical effect, reference is made to the following non-limiting Examples.

EXAMPLE 1

Very few αβ TCR pairs have been identified from the T cells that recognize the LMP2, LMP1 and EBNA1 proteins of EBV. The present Example describes the identification of αβ TCR pairs that recognize epitopes derived from the LMP1 and LMP2 antigens and presented in association with several frequently-occurring human leukocyte antigens.

Materials and Methods

Generation of T Cell Lines

Peripheral blood mononuclear cells (PBMCs) were isolated by Ficoll-Hypaque centrifugation into RPMI 1640 medium supplemented with 10% FCS (R10). Blood donors were healthy, EBV-seropositive individuals who had given written informed consent. Approval for this research was obtained from the QIMR Berghofer Medical Research Institute Human Ethics Committee (Brisbane, Australia). EBV-specific T cell cultures were raised by culturing PBMCs ($2\times10^6$/2 ml well) with autologous PBMCs that had been treated with a synthetic peptide (1 g/ml) and washed once to remove unbound peptide ($10^6$/2 ml well). Cultures were supplemented with recombinant IL-2 (20 IU/ml) from day 3 and analyzed on day 10. Synthetic peptides were purchased from GL Biochem (Shanghai, China) and dissolved in DMSO.

Sorting of Single $CD8^+$ T Cells Specific for Each EBV Peptide Epitope

T cell lines were labelled with an allophycocyanin (APC)-conjugated HLA-peptide multimer (ProImmune Ltd., Oxford, UK) by incubation for 30 minutes at room temperature. Cells were then washed and incubated with Cy5.5-PerCP conjugated anti-human CD8 mAb (BioLegend, San Diego, CA) for 30 minutes at 4° C. Cells were washed, analyzed and sorted as single cells into 96-well PCR plates (Eppendorf, Hamburg, Germany) using the FACS Aria III flow cytometer (BD Biosciences).

Single-Cell Paired TCRαβ Sequencing

Multiplex-nested RT-PCR for paired TCRαβ sequencing was performed as previously described [14]. Briefly, mRNA in the cells was reverse transcribed to create cDNA which was then subjected to 2 rounds of PCR using specific primers that amplified the α and β chains of the TCR gene present in the one cell. This PCR product was purified and sequenced then analysed using the IMGT website software. The α and β chains with their respective CDR3 regions were determined.

TCR Gene Transfer

Some of the TCR α and β chain sequences were modified by codon optimization and the introduction of a single cysteine residue into each receptor chain to promote the formation of an additional interchain disulfide bond and reduce the likelihood of TCR mispairing with the endogenous TCR subunits [15]. The TCRs were also modified within the constant regions to enhance stability and expression levels by exchange of selected amino acids with the murine counterparts. For the α-chain the amino acid exchanges were made at positions 90, 91, 92 and 93 and for the β-chain the amino acid exchanges were at positions 18, 22, 133, 136 and 139 [16]. The TCR α and β chain sequences were then synthetically introduced into a lentivirus plasmid as one transcript using a cleavage protein to produce the α and β chains as 2 products in equal ratios driven by the promoter human elongation factor-1 alpha (EF-1 alpha) (Biosettia Inc., San Diego). The Lentiplasmid was then used to produce lentivirus (Biosettia Inc., San Diego) that was transduced into human T cells. The human T cells were either the Jurkat cell line or T cells from healthy donors that had been stimulated with CD3-CD28 beads (Thermo Fisher Scientific, Massachusetts) and expanded in culture with R10 supplemented with recombinant IL-2 (20 IU/ml). Cells were then tested for the presence of the introduced TCR by FACS analysis on the Fortessa 4 using the corresponding peptide-HLA multimer and TCR Vβ antibody (where available). The ability of the transferred TCR to recognize the relevant EBV epitope was also confirmed in some cases by using γ-interferon (IFN-γ) enzyme-linked immunosorbent spot (ELISpot) assays or by FACS analysis of Granzyme B expression.

ELISpot Assays

IFN-γ ELISpot assays were performed using cytokine capture and detection reagents according to the manufacturer's instructions (Mabtech, Stockholm, Sweden). Briefly, 96-well nitrocellulose plates pre-coated with anti-IFN-γ monoclonal antibody were seeded with $1\text{-}4\times10^4$/well TCR-transduced T cells and lymphoblastoid cell lines (LCLs; $10^4$/well) that had, or had not, been treated with an EBV peptide at various concentrations. After incubation for 18 hours at 37° C. in 5% $CO^2$, the cells were discarded and captured IFN-γ was detected with a biotinylated anti-IFNγ antibody, followed by development with an alkaline phosphatase substrate solution (BCIP/NBT-plus). All samples were tested in triplicate and spots were counted using an automated plate counter.

Mouse Model of EBV-Induced B Cell Lymphoma and Treatment with TCR-Transgenic T Cells EBV-positive tumors were established in 18 NOD/RAG mice by subcutaneous injection of $5\times10^6$ LCLs from an HLA-A*02:01$^+$ individual. Tumor size was monitored daily at the injection site, and mice were euthanized when tumors reached a maximum of 1000 cubic mm. Tumor treatment was on days 2 and 9 following tumor inoculation and consisted of two intravenous injections with TCR-transgenic T cells ($8\times10^6$ and $6\times10^6$, respectively) derived from a healthy EBV-sero-negative donor and generated by stimulation with CD3-CD28 beads and expansion in culture with R10 supplemented with recombinant IL-2 (20 IU/ml). Prior to injection into the mice, these expanded T cells were transduced with a TCR specific for HLA-A*02:01-FLYALALLL, followed by sorting using the FACS Aria III flow cytometer for co-expression of CD8 and the β-chain variable gene used by the transduced TCR (using a TCR Vβ13S1 antibody) (for 6 mice). As controls, untransduced T cells from the same donor (sorted for CD8 expression) or PBS were also intravenously injected on days 2 and 9 (6 mice each). Tumour size was determined by caliper measurement of perpendicular diameters of each tumour and was calculated using the following formula: tumour volume ($mm^3$)=[(length)×(width)×(width)]/2

Results

The present Example involves the identification of TCRs that recognize the LMP2 and LMP1 antigens of EBV, and are restricted by human leukocyte antigens that are occur frequently throughout most world-wide populations. These could be used in TCR gene therapy to treat many EBV-associated diseases.

The first step involved sorting single T cells from peptide-stimulated T cell cultures using flow cytometry, following staining with anti-CD8 antibodies and peptide-HLA multimers that bind specifically to the relevant TCR. The flow cytometry data for five of the LMP2 epitopes and an HLA-A*02:01-restricted LMP1 epitope are shown in FIG. 1-6.

Using single-cell TCR sequencing on healthy EBV-seropositive blood donors expressing one or more frequently occurring HLA alleles (A*02:01, A*11:01, A*24:02, or B*40:01; Table 1), we have successfully identified TCR sequences that recognize the LMP2 epitopes IEDPPFNSL (presented by HLA-B*40:01; Table 2; [17]), SSCSSCPLSK (presented by HLA-A*11:01; Table 3; [17]), TYGPVFMSL/TYGPVFMCL (presented by HLA-A*24:02; Table 4; [17]), PYLFWLAAI (presented by HLA-A*2402; Table 5; [18]), the LMP1 epitope YLLEMLWRL (presented by HLA-A*02:01; Table 6; [19]), and the LMP2 epitope FLYALALLL (presented by HLA-A*02:01; Table 7; Lautscham et al, J. Virol. 2003 February; 77(4):2757-61). The frequency of these four HLA alleles in different population groups is shown in Table 8.

Figure 7:
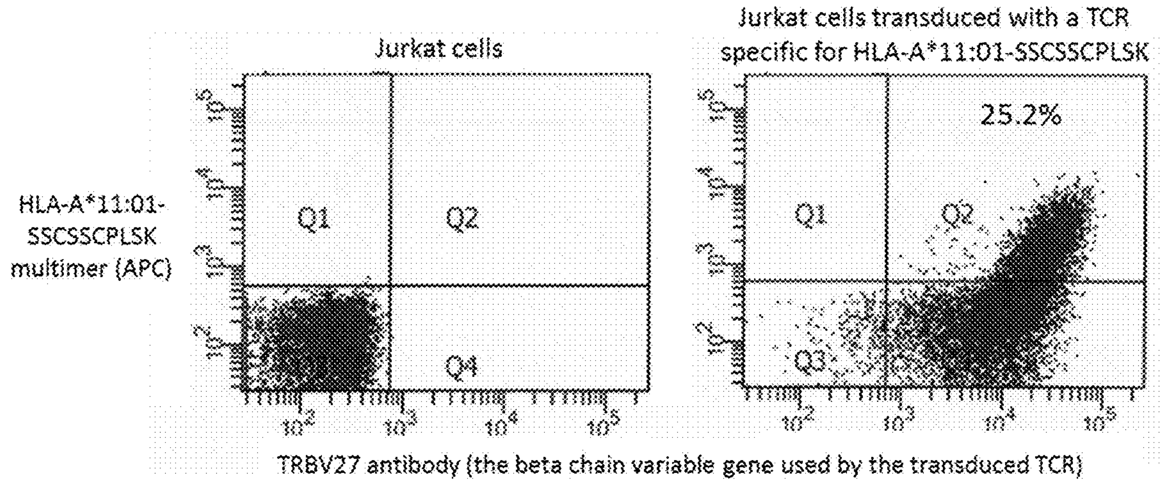
FIG. 7. Flow cytometry data for sorting and identification of Jurkat T cells expressing TCRs specific for HLA-A*11:01-SSCSSCPLSK.
Figure 8:
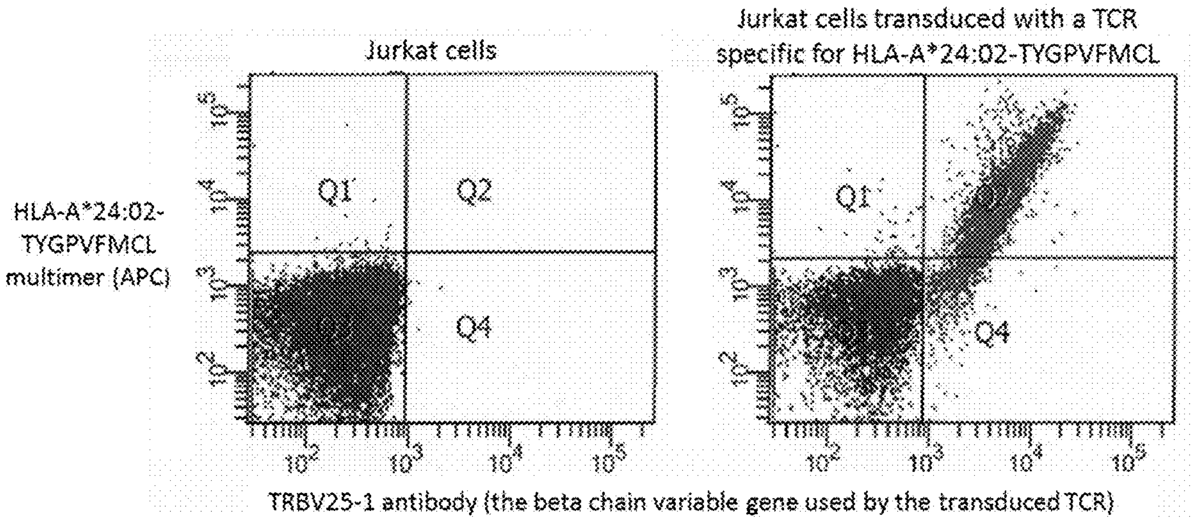
FIG. 8. Flow cytometry data for sorting and identification of Jurkat T cells expressing TCRs specific for HLA-A*24:02-TYGPVFMCL.

To confirm that the TCRs that were identified using the aforementioned methodology do indeed recognize the EBV epitopes used to sort the T cells, representative TCRs specific for some of the EBV peptides (highlighted in aqua in Tables 2-4 and 7) were synthetically engineered into a lentivirus expression system. The recombinant lentivirus constructs were then used to infect the Jurkat T cell line, and these were stained with an antibody specific for the relevant TCR β chain variable gene product and a multimer of the relevant peptide-HLA complex. Data for the TCRs specific for SSCSSCPLSK-HLA-A*11:01 (FIG. 7) and TYGPVFMCL-HLA-A*24:02 (FIG. 8) confirm that a significant proportion of the transduced Jurkat cells express the correctly assembled TCR on the cell surface.

Figure 9:
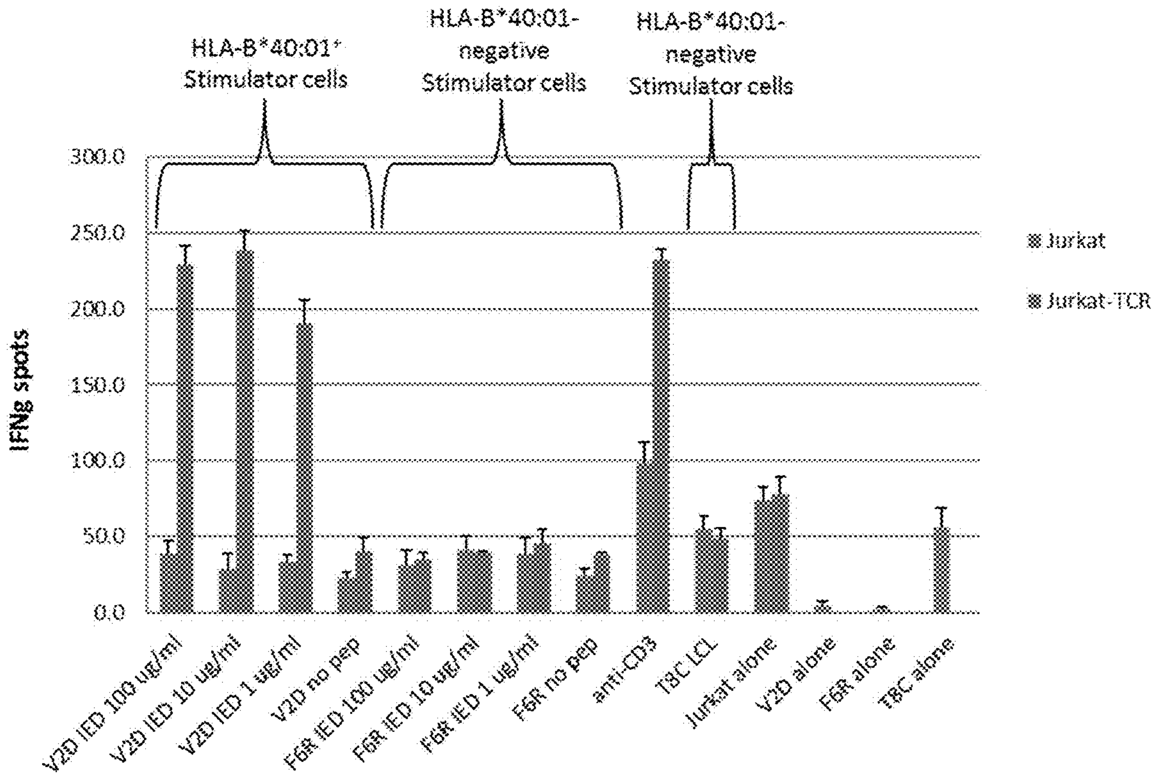
FIG. 9. Jurkat T cells, transduced to express a TCR specific for HLA-B*40:01-IEDPPFNSL, were tested for recognition of HLA-B*40:01$^+$ B cells (V2D) that were pre-treated with IEDPPFNSL peptide (100 ug/ml, 10 ug/ml, or 1 ug/ml) or left untreated. The elispot assay measured T cell activation by gamma interferon release. As a positive control, antibody to CD3 was used to stimulate the TCR-transduced Jurkat cells, and as a negative control HLA-B*40:01-negative B cells (F6R and T8C) were also added to the Jurkat cells. This assay clearly shows that Jurkat cells transduced with an IEDPPFNSL-specific TCR recognize B cells presenting HLA-B*40:01-IEDPPFNSL.
Figure 10:
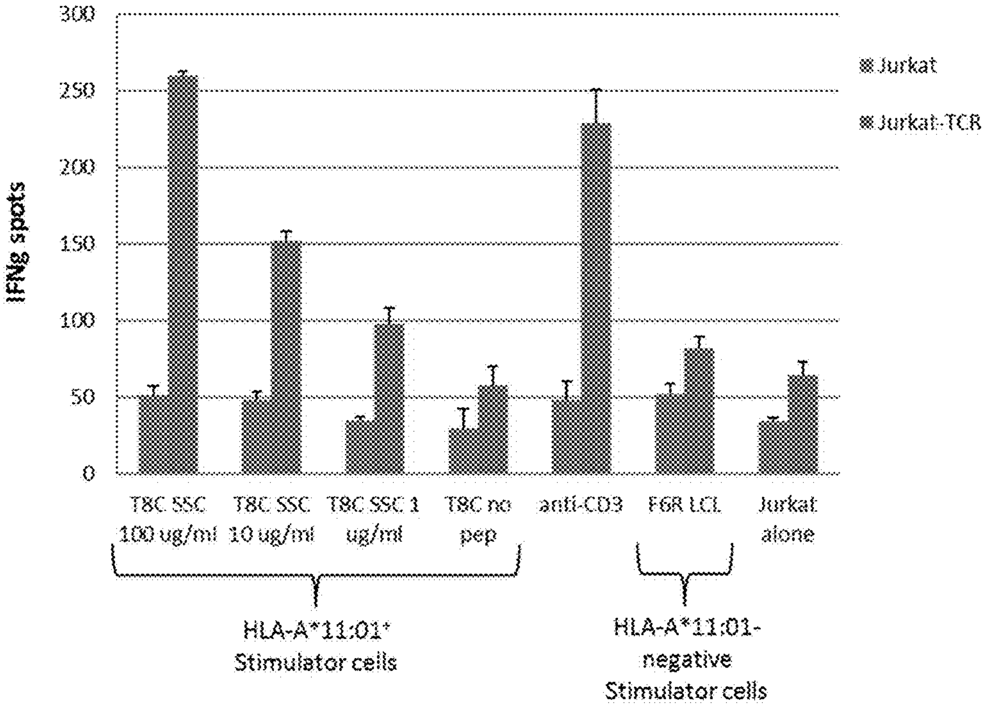
FIG. 10. Jurkat T cells, transduced to express a TCR specific for HLA-A*11:01-SSCSSCPLSK, were tested for recognition of HLA-A*11:01$^+$ B cells (T8C) that were pre-treated with SSCSSCPLSK peptide (100 ug/ml, 10 ug/ml, or 1 ug/ml) or left untreated. The elispot assay measured T cell activation by gamma interferon release. As a positive control, antibody to CD3 was used to stimulate the TCR-transduced Jurkat cells, and as a negative control HLA-A*11:01-negative B cells (F6R) were also added to the Jurkat cells. This assay clearly shows that Jurkat cells transduced with an SSCSSCPLSK-specific TCR recognize B cells presenting HLA-A*11:01-SSCSSCPLSK.

The Jurkat T cell line transduced with the recombinant lentivirus constructs were then screened for recognition of the relevant peptide-HLA complex using functional assays. These ELISpot assays detected interferon gamma release from the TCR-transduced Jurkat cells when added to stimulator cells that expressed the relevant HLA allele and had been pre-treated with the relevant EBV peptide (FIGS. 9 & 10).

Figure 11:
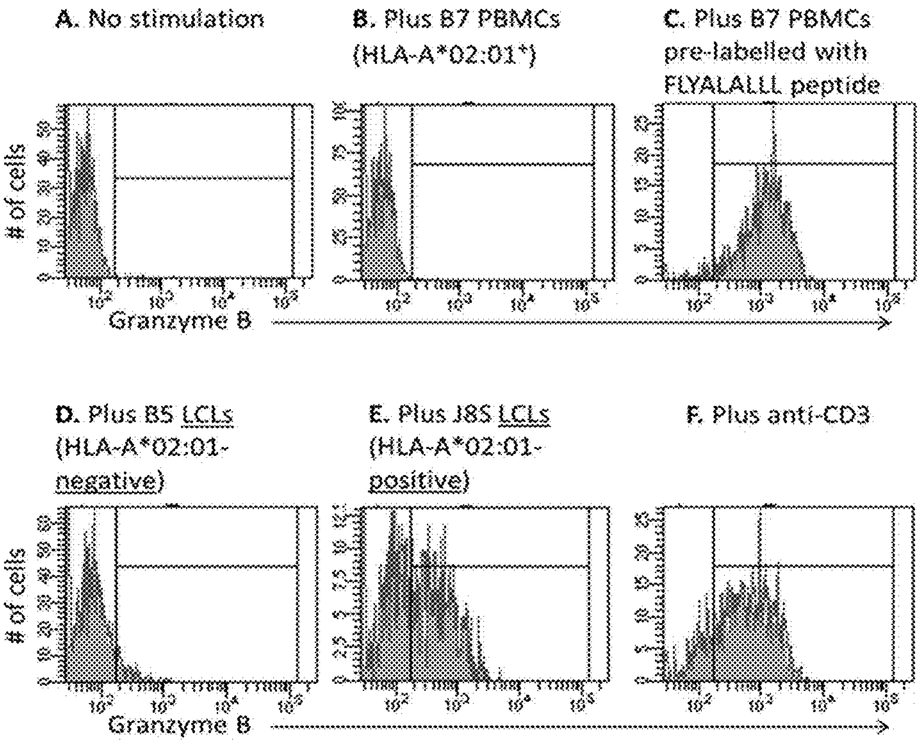
FIG. 11. Granzyme B expression by primary T cells transduced with a TCR specific for HLA-A*02:01-FLYALALLL. Flow cytometry data for TCR-transduced T cells (A) without stimulation, (B) with added HLA-A*02:01$^+$ PBMCs, (C) with added HLA-A*02:01$^+$ PBMCs that were pre-treated with the FLYALALLL peptide (1 μM); (D) with added HLA-A*02:01-negative LCLs; (E) with added HLA-A*02:01$^+$ LCLs; and (F) with added anti-CD3. These results are for cells initially gated for co-staining with an HLA-A*02:01-FLYALALLL multimer and anti-CD8.

Primary human T lymphocytes were also transduced with a recombinant lentivirus construct encoding a TCR specific for the LMP2 antigen. This TCR was specific for the HLA-A*02:01-FLYALALLL complex, and it was screened for recognition of this peptide-HLA complex using a functional assay that measured granzyme B expression with flow cytometry. Granzyme B expression by the TCR-transduced T cells was observed following the addition of HLA-A*02:01$^+$ PBMCs that had been pre-treated with FLYALALLL peptide, but not without peptide treatment, thereby confirming the specificity of this TCR (FIG. 11). Importantly, the TCR-transduced T cells were also activated to express granzyme B with the addition of HLA-A*02:01$^+$ LCLs, but not HLA-A*02:01-negative LCLs, demonstrating that this TCR can recognize EBV-infected cells, without exogenous peptide addition (FIG. 11).

Figure 12:
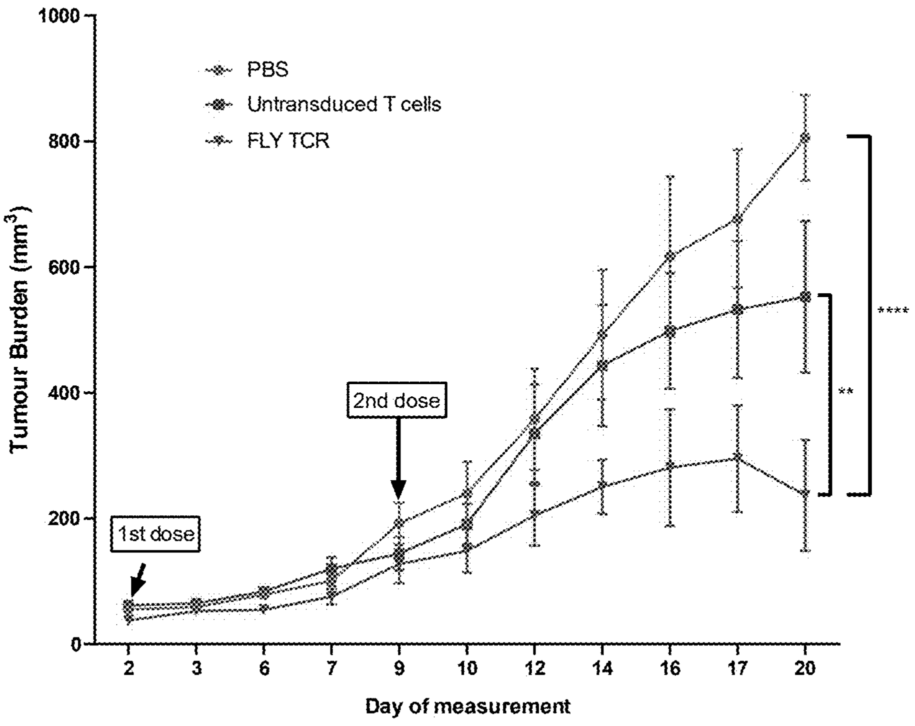
FIG. 12. Mouse model of EBV-induced B cell lymphoma and treatment with TCR-transgenic T cells. EBV-positive tumors were established in NOD/RAG mice by subcutaneous injection of EBV-positive human B lymphocytes (LCLs) that expressed HLA-A*02:01. Tumors were visible from day 2, and treatment was administered on days 2 and 9 following tumor inoculation. This consisted of two intravenous injections with transgenic T cells derived from a healthy EBV-sero-negative donor that had been generated by stimulation with CD3-CD28 beads. These T cells were transduced with a TCR specific for HLA-A*02:01-FLYALALLL. As controls, untransduced T cells or PBS were also intravenously injected on days 2 and 9. The tumor volume is plotted on the y axis. Time after tumor cell injection is plotted on the x axis. The mean values from each group are plotted. Error bars represent the SEM (n=6 mice per group; ** $p \leq 0.0001$;  $p \leq 0.01$, analyzed by two-way repeated measures ANOVA).

To investigate the in vivo efficacy of primary human T cells transduced with LMP2-specific TCRs in controlling EBV-infected tumors, a mouse model of EBV-induced B cell lymphoma was utilized. EBV-positive tumors were established in NOD/RAG mice by subcutaneous injection of EBV-positive human B lymphocytes (LCLs) that expressed HLA-A*02:01. Tumors were visible from day 2, and treatment was administered on days 2 and 9 following tumor inoculation. This consisted of two intravenous injections with transgenic T cells ($8\times10^6$ and $6\times10^6$, respectively) derived from a healthy EBV-sero-negative donor that had been generated by stimulation with CD3-CD28 beads. These T cells were transduced with a TCR specific for HLA-A*02:01-FLYALALLL (6 mice). As controls, untransduced T cells or PBS were also intravenously injected on days 2 and 9 (6 mice each). The results of this experiment clearly demonstrated that TCRs specific for this LMP2 epitope induced a statistically significant regression of tumors compared to the control groups (FIG. 12).

TABLE 1

Class I HLA Type of Donors used in Study

| Donor | HLA-A | HLA-B |
|---|---|---|
| N3M | A*24:02, A*24:10 | B*38:02, B*40:01 |
| B24 | A*02:01, A*02:01 | B*40:01, B*40:01 |
| A5L | A*02:01, A*23:01 | B*40:01, B*44:03 |
| B31 | A*24:02, A*24:07 | B*15:02, B*40:01 |
| R7Z (Chinese) | A*11:01, A*33:03 | B*46:01, B*58:01 |
| B5F | A*11:01, A*24:02 | B*15:01, B*35:41 |
| T3V (Vietnamese) | A*11:02, A*29:01 | B*07:05, B*27:04 |
| P6G (Caucasian) | A*02:01, A*11:01 | B*44:02, B*44:03 |
| A4T (Chinese) | A*02:07, A*11:01 | B*13:01, B*40:01 |
| D2M (Caucasian) | A*24:02, A*29:02 | B*44:03, B*44:05 |
| B33 | A*24:02, A*29:02 | B*18:01, B*44:03 |
| N2W (Caucasian) | A*02:01, A*25:01 | B*15:01, B*40:01 |
| B87 | A*01:01, A*02:01 | B*08:01, B*57:01 |
| Y6W (Singapore Chinese) | A*24:02, A*29:01 | B*07:05, B*39:09 |
| J9B (Caucasian) | A*01:01, A*02:01 | B*44:02, B*49:01 |
| T4W (Caucasian) | A*02:01, A*02:01 | B*07:02, B*07:02 |

TABLE 2

α- and β-chain gene usage and CDR sequences for TCRs specific for HLA-B*40:01-IEDPPFNSL

| Alpha Chain: V & J gene usage and CDR sequences | Beta Chain: V & J gene usage and CDR sequences | Number of cells | Donor & Clone no. |
|---|---|---|---|
| TRAV21<br>TRAJ28*01<br>CDR1: DSAIYN<br>[SEQ ID NO: 7]<br>CDR2: IQSSQRE<br>[SEQ ID NO: 169]<br>CDR3: CAVYSGAGSYQLTF<br>[SEQ ID NO: 331] | TRBV27*01<br>TRBJ2-7*01<br>CDR1: MNHEY<br>[SEQ ID NO: 88]<br>CDR2: SMNVEV<br>[SEQ ID NO: 250]<br>CDR3: CASRTGGVNEQYF<br>[SEQ ID NO: 412] | 2 | Donor<br>N3M<br>Clone 1 |
| TRAV1-2*01<br>TRAJ9*01<br>CDR1: TSGFNG<br>[SEQ ID NO: 8] | TRBV9*01<br>TRBJ2-1*01<br>CDR1: SGDLS<br>[SEQ ID NO: 89] | 4 | Donor<br>B24<br>Clone 1 |

TABLE 2-continued

α- and β-chain gene usage and CDR sequences for TCRs specific for HLA-B*40:01-IEDPPFNSL

| Alpha Chain: V & J gene usage and CDR sequences | Beta Chain: V & J gene usage and CDR sequences | Number of cells | Donor & Clone no. |
|---|---|---|---|
| CDR2: NVLDG<br>[SEQ ID NO: 170]<br>CDR3: CAVGGNTGGFKTIF<br>[SEQ ID NO: 332] | CDR2: YYNGEE<br>[SEQ ID NO: 251]<br>CDR3: CASSAGQGLAGDEQFF<br>[SEQ ID NO: 413] | | |
| TRAV19*01<br>TRAJ42*01<br>CDR1: TRDTTYY<br>[SEQ ID NO: 9]<br>CDR2: RNSFDEQ<br>[SEQ ID NO: 171]<br>CDR3: CALSEARGSQGNLIF<br>[SEQ ID NO: 333] | TRBV4-1<br>TRBJ2-1*01<br>CDR1: MGHRA<br>[SEQ ID NO: 90]<br>CDR2: YSYEKL<br>[SEQ ID NO: 252]<br>CDR3: CASSQEAASGGLINEQFF<br>[SEQ ID NO: 414] | 3 | Donor<br>B24<br>Clone 2 |
| TRAV26-2*01<br>TRAJ9*01<br>CDR1: TISGTDY<br>[SEQ ID NO: 10]<br>CDR2: GLTS<br>[SEQ ID NO: 172]<br>CDR3: CILRDVTGGFKTIF<br>[SEQ ID NO: 334] | TRBV27*01<br>TRBJ2-7*01<br>CDR1: MNHEY<br>[SEQ ID NO: 91]<br>CDR2: SMNVEV<br>[SEQ ID NO: 253]<br>CDR3: CASSYSGGPLYEQYF<br>[SEQ ID NO: 415] | 1 | Donor<br>B24<br>Clone 3 |
| TRAV35*02<br>TRAJ21*01<br>CDR1: SIFNT<br>[SEQ ID NO: 11]<br>CDR2: LYKAGE<br>[SEQ ID NO: 173]<br>CDR3: CAGRGSYNFNKFYF<br>[SEQ ID NO: 335] | TRBV27*01<br>TRBJ1-2*01<br>CDR1: MNHEY<br>[SEQ ID NO: 92]<br>CDR2: SMNVEV<br>[SEQ ID NO: 254]<br>CDR3: CASSYAGGPQYGYTF<br>[SEQ ID NO: 416] | 1 | Donor<br>B24<br>Clone 4 |
| TRAV1-1<br>TRAJ23*01<br>CDR1: TSGFYG<br>[SEQ ID NO: 12]<br>CDR2: NALDG<br>[SEQ ID NO: 174]<br>CDR3: CASSEGKLIF<br>[SEQ ID NO: 336] | TRBV20-1<br>TRBJ2-1*01<br>CDR1: DFQATT<br>[SEQ ID NO: 93]<br>CDR2: SNEGSKA<br>[SEQ ID NO: 255]<br>CDR3: CSARDGSPIAGGLNEQFF<br>[SEQ ID NO: 417] | 18 | Donor<br>A5L<br>Clone 1 |
| TRAV16*01<br>TRAJ36*01<br>CDR1: YSGSPE<br>[SEQ ID NO: 13]<br>CDR2: HIS<br>[SEQ ID NO: 175]<br>CDR3: CALRWQTGANNLFF<br>[SEQ ID NO: 337] | TRBV27*01<br>TRBJ2-7*01<br>CDR1: MNHEY<br>[SEQ ID NO: 94]<br>CDR2: SMNVEV<br>[SEQ ID NO: 256]<br>CDR3: CASSYSGGPLYEQYF<br>[SEQ ID NO: 418] | 4 | Donor<br>A5L<br>Clone 2 |
| TRAV1-2*01<br>TRAJ9*01<br>CDR1: TSGFNG<br>[SEQ ID NO: 14]<br>CDR2: NVLDG<br>[SEQ ID NO: 176]<br>CDR3: CAVNGGTGGFKTIF<br>[SEQ ID NO: 338] | TRBV9*01<br>TRBJ2-3*01<br>CDR1: SGDLS<br>[SEQ ID NO: 95]<br>CDR2: YYNGEE<br>[SEQ ID NO: 257]<br>CDR3: CASSVGEGLAGDTQYF<br>[SEQ ID NO: 419] | 2 | Donor<br>A5L<br>Clone 3 |
| TRAV24*01<br>TRAJ8*01<br>CDR1: SSNFYA<br>[SEQ ID NO: 15]<br>CDR2: MTLNGD<br>[SEQ ID NO: 177]<br>CDR3: CASPRTGFQKLVF<br>[SEQ ID NO: 339] | TRBV27*01<br>TRBJ2-1*01<br>CDR1: MNHEY<br>[SEQ ID NO: 96]<br>CDR2: SMNVEV<br>[SEQ ID NO: 258]<br>CDR3: CASRYSGGPLYEQFF<br>[SEQ ID NO: 420] | 2 | Donor<br>A5L<br>Clone 4 |
| TRAV1-1<br>TRAJ23*01<br>CDR1: TSGFYG<br>[SEQ ID NO: 16] | TRBV20-1<br>TRBJ2-1*01<br>CDR1: DFQATT<br>[SEQ ID NO: 97] | 1 | Donor<br>A5L<br>Clone 5 |

TABLE 2-continued

α- and β-chain gene usage and CDR sequences for TCRs specific for HLA-B*40:01-IEDPPFNSL

| Alpha Chain: V & J gene usage and CDR sequences | Beta Chain: V & J gene usage and CDR sequences | Number of cells | Donor & Clone no. |
|---|---|---|---|
| CDR2: NALDG<br>[SEQ ID NO: 178]<br>CDR3: CASTEGKLIF<br>[SEQ ID NO: 340] | CDR2: SNEGSKA<br>[SEQ ID NO: 259]<br>CDR3: CSARDGSPIAGGLNEQFF<br>[SEQ ID NO: 421] | | |
| TRAV38-1<br>TRAJ23*01<br>CDR1: TSENNYY<br>[SEQ ID NO: 17]<br>CDR2: QEAYKQQ<br>[SEQ ID NO: 179]<br>CDR3: CAFMTVYNQGGKLIF<br>[SEQ ID NO: 341] | TRBV4-1<br>TRBJ2-3*01<br>CDR1: MGHRA<br>[SEQ ID NO: 98]<br>CDR2: YSYEKL<br>[SEQ ID NO: 260]<br>CDR3: CASSQEAGRQNTQYF<br>[SEQ ID NO: 422] | 4 | Donor B31 Clone 1 |
| TRAV21<br>TRAJ28*01<br>CDR1: DSAIYN<br>[SEQ ID NO: 18]<br>CDR2: IQSSQRE<br>[SEQ ID NO: 180]<br>CDR3: CAPYSGAGAYQLTF<br>[SEQ ID NO: 342] | TRBV27*01<br>TRBJ2-1*01<br>CDR1: MNHEY<br>[SEQ ID NO: 99]<br>CDR2: SMNVEV<br>[SEQ ID NO: 261]<br>CDR3: CATRTGAVNEQFF<br>[SEQ ID NO: 423] | 1 | Donor B31 Clone 2 |

The TCR highlighted in aqua a subsequently synthetically engineered into a lentivirus expression system.

TABLE 3

α- and β-chain gene usage and CDR sequences for TCRs specific for HLA-A*11:01-SSCSSCPLSK

| Alpha Chain: V & J gene usage and CDR sequences | Beta Chain: V & J gene usage and CDR sequences | Number of cells | Donor & Clone no. |
|---|---|---|---|
| TRAV21*01<br>TRAJ52*01<br>CDR1: DSAIYN<br>[SEQ ID NO: 19]<br>CDR2: IQSSQRE<br>[SEQ ID NO: 181]<br>CDR3: CAVWAGGTSYGKLTF<br>[SEQ ID NO: 343] | TRBV28*01<br>TRBJ1-6*01<br>CDR1: MDHEN<br>[SEQ ID NO: 100]<br>CDR2: SYDVKM<br>[SEQ ID NO: 262]<br>CDR3: CASSPAGRPGKPLHF<br>[SEQ ID NO: 424] | 1 | Donor R7Z Clone 1 |
| TRAV22*01<br>TRAJ43*01<br>CDR1: DSVNN<br>[SEQ ID NO: 20]<br>CDR2: IPSG<br>[SEQ ID NO: 182]<br>CDR3: CAVVINNDMRF<br>[SEQ ID NO: 344] | TRBV9*01<br>TRBJ2-7*01<br>CDR1: SGDLS<br>[SEQ ID NO: 101]<br>CDR2: YYNGEE<br>[SEQ ID NO: 263]<br>CDR3: CASSVAPFYEQYF<br>[SEQ ID NO: 425] | 1 | Donor R7Z Clone 2 |
| TRAV3*01<br>TRAJ36*01<br>CDR1: VSGNPY<br>[SEQ ID NO: 21]<br>CDR2: YITGDNLV<br>[SEQ ID NO: 183]<br>CDR3: CAVREASGANNLFF<br>[SEQ ID NO: 345] | TRBV30*01<br>TRBJ1-6*01<br>CDR1: GTSNPN<br>[SEQ ID NO: 102]<br>CDR2: SVGIG<br>[SEQ ID NO: 264]<br>CDR3: CAWSPQGNSPLHF<br>[SEQ ID NO: 426] | 1 | Donor R7Z Clone 3 |
| TRAV8-2<br>TRAJ5*01<br>CDR1: SSYSPS<br>[SEQ ID NO: 22]<br>CDR2: YTSAATL<br>[SEQ ID NO: 184]<br>CDR3: CVVSYLGDTGRRALTF<br>[SEQ ID NO: 346] | TRBV2<br>TRBJ2-2*01<br>CDR1: SNHLY<br>[SEQ ID NO: 103]<br>CDR2: FYNNEI<br>[SEQ ID NO: 265]<br>CDR3: CASSESGSPTGELFF<br>[SEQ ID NO: 427] | 1 | Donor R7Z Clone 4 |

TABLE 3-continued

α- and β-chain gene usage and CDR sequences for TCRs specific for HLA-A*11:01-SSCSSCPLSK

| Alpha Chain: V & J gene usage and CDR sequences | Beta Chain: V & J gene usage and CDR sequences | Number of cells | Donor & Clone no. |
|---|---|---|---|
| TRAV22*01<br>TRAJ43*01<br>CDR1: DSVNN<br>[SEQ ID NO: 23]<br>CDR2: IPSG<br>[SEQ ID NO: 185]<br>CDR3: CAVVGNNDMRF<br>[SEQ ID NO: 347] | TRBV9*01<br>TRBJ2-7*01<br>CDR1: SGDLS<br>[SEQ ID NO: 104]<br>CDR2: YYNGEE<br>[SEQ ID NO: 266]<br>CDR3: CASSVAPWYEQYF<br>[SEQ ID NO: 428] | 1 | Donor<br>R7Z<br>Clone 5 |
| TRAV22*01<br>TRAJ43*01<br>CDR1: DSVNN<br>[SEQ ID NO: 24]<br>CDR2: IPSG<br>[SEQ ID NO: 186]<br>CDR3: CAVLNNNDMRF<br>[SEQ ID NO: 348] | TRBV9*01<br>TRBJ2-1*01<br>CDR1: SGDLS<br>[SEQ ID NO: 105]<br>CDR2: YYNGEE<br>[SEQ ID NO: 267]<br>CDR3: CASSVSSWYEQFF<br>[SEQ ID NO: 429] | 2 | Donor<br>B5F<br>Clone 1 |
| TRAV13-2<br>TRAJ13*02<br>CDR1: NSASDY<br>[SEQ ID NO: 25]<br>CDR2: IRSNMD<br>[SEQ ID NO: 187]<br>CDR3: CAETPGGYQKVTF<br>[SEQ ID NO: 349] | TRBV27*01<br>TRBJ1-6*01<br>CDR1: MNHEY<br>[SEQ ID NO: 106]<br>CDR2: SMNVEV<br>[SEQ ID NO: 268]<br>CDR3: CASSLWTSNSPLHF<br>[SEQ ID NO: 430] | 17 | Donor<br>B5F<br>Clone 2 |
| TRAV29/DV5*01<br>TRAJ26*01<br>CDR1: NSMFDY<br>[SEQ ID NO: 26]<br>CDR2: ISSIKDK<br>[SEQ ID NO: 188]<br>CDR3: CAASAGGQNFVF<br>[SEQ ID NO: 350] | TRBV10-3<br>TRBJ2-1*01<br>CDR1: ENHRY<br>[SEQ ID NO: 107]<br>CDR2: SYGVKD<br>[SEQ ID NO: 269]<br>CDR3: CAIRRGGSSYNEQFF<br>[SEQ ID NO: 431] | 2 | Donor<br>T3V<br>Clone 1 |
| TRAV1-2*01<br>TRAJ33*01<br>CDR1: TSGFNG<br>[SEQ ID NO: 27]<br>CDR2: NVLDG<br>[SEQ ID NO: 189]<br>CDR3: CAVKDSNYQLIW<br>[SEQ ID NO: 351] | TRBV6-4<br>TRBJ2-3*01<br>CDR1: MRHNA<br>[SEQ ID NO: 108]<br>CDR2: SNTAGT<br>[SEQ ID NO: 270]<br>CDR3: CASSADQGDGTDTQYF<br>[SEQ ID NO: 432] | 1 | Donor<br>T3V<br>Clone 2 |
| TRAV1-1*01<br>TRAJ31*01<br>CDR1: TSGFYG<br>[SEQ ID NO: 28]<br>CDR2: NALDG<br>[SEQ ID NO: 190]<br>CDR3: CAVPRRNNNARLMF<br>[SEQ ID NO: 352] | TRBV27*01<br>TRBJ1-1*01<br>CDR1: MNHEY<br>[SEQ ID NO: 109]<br>CDR2: SMNVEV<br>[SEQ ID NO: 271]<br>CDR3: CASSLNTGMNTEAFF<br>[SEQ ID NO: 433] | 1 | Donor<br>T3V<br>Clone 3 |
| TRAV21<br>TRAJ28*01<br>CDR1: DSAIYN<br>[SEQ ID NO: 29]<br>CDR2: IQSSQRE<br>[SEQ ID NO: 191]<br>CDR3: CAVGGDDSGAGSYQLTF<br>[SEQ ID NO: 353] | TRBV9*01<br>TRBJ2-1*01<br>CDR1: SGDLS<br>[SEQ ID NO: 110]<br>CDR2: YYNGEE<br>[SEQ ID NO: 272]<br>CDR3: CASSRPEGIYNEQFF<br>[SEQ ID NO: 434] | 5 | Donor<br>P6G<br>Clone 1 |
| TRAV25*01<br>TRAJ23*01<br>CDR1: TTLSN<br>[SEQ ID NO: 30]<br>CDR2: LVKSGE<br>[SEQ ID NO: 192]<br>CDR3: CAGPGIYNQGGKLIF<br>[SEQ ID NO: 354] | TRBV19<br>TRBJ2-7*01<br>CDR1: LNHDA<br>[SEQ ID NO: 111]<br>CDR2: SQIVND<br>[SEQ ID NO: 273]<br>CDR3: CASSPGLADYEQYF<br>[SEQ ID NO: 435] | 1 | Donor<br>P6G<br>Clone 2 |

TABLE 3-continued

α- and β-chain gene usage and CDR sequences for TCRs specific for HLA-A*11:01-SSCSSCPLSK

| Alpha Chain: V & J gene usage and CDR sequences | Beta Chain: V & J gene usage and CDR sequences | Number of cells | Donor & Clone no. |
|---|---|---|---|
| TRAV14<br>TRAJ52*01<br>CDR1: TSDQSYG<br>[SEQ ID NO: 31]<br>CDR2: QGSYDEQ<br>[SEQ ID NO: 193]<br>CDR3: CAMSSSNAGGTSYGKLTF<br>[SEQ ID NO: 355] | TRBV30<br>TRBJ2-7*01<br>CDR1: GTSNPN<br>[SEQ ID NO: 112]<br>CDR2: SVGIG<br>[SEQ ID NO: 274]<br>CDR3: CAWRLEQGLNYEQYF<br>[SEQ ID NO: 436] | 1 | Donor<br>P6G<br>Clone 3 |
| TRAV29/DV5*01<br>TRAJ29*01<br>CDR1: NSMFDY<br>[SEQ ID NO: 32]<br>CDR2: ISSIKDK<br>[SEQ ID NO: 194]<br>CDR3: CAASGLVEGNTPLVF<br>[SEQ ID NO: 356] | TRBV11-2*01<br>TRBJ2-7*01<br>CDR1: SGHAT<br>[SEQ ID NO: 113]<br>CDR2: FQNNGV<br>[SEQ ID NO: 275]<br>CDR3: CASSLFPGTGIHEQYF<br>[SEQ ID NO: 437] | 2 | Donor<br>A4T<br>Clone 1 |

The TCR highlighted in aqua was subsequently synthetically engineered into a lentivirus expression system.

TABLE 4

α- and β-chain gene usage and CDR sequences for TCRs specific for HLA-A*24:02-TYGPVFMSL/TYGPVFMCL

| Alpha Chain: V & J gene usage and CDR sequences | Beta Chain: V & J gene usage and CDR sequences | Number of cells | Donor & Clone no. |
|---|---|---|---|
| TRAV17*01<br>TRAJ7*01<br>CDR1: TSINN<br>[SEQ ID NO: 33]<br>CDR2: IRSNER<br>[SEQ ID NO: 195]<br>CDR3: CATDGPYGNNRLAF<br>[SEQ ID NO: 357] | TRBV25-1*01<br>TRBJ2-1*01<br>CDR1: MGHDK<br>[SEQ ID NO: 114]<br>CDR2: SYGVNS<br>[SEQ ID NO: 276]<br>CDR3: CASSPLGRSSSYNEQFF<br>[SEQ ID NO: 438] | 16 | Donor<br>D2M<br>Clone 1 |
| TRAV17*01<br>TRAJ7*01<br>CDR1: TSINN<br>[SEQ ID NO: 34]<br>CDR2: IRSNER<br>[SEQ ID NO: 196]<br>CDR3: CATDGPYGNNRLAF<br>[SEQ ID NO: 358] | TRBV25-1*01<br>TRBJ2-1*01<br>CDR1: MGHDK<br>[SEQ ID NO: 115]<br>CDR2: SYGVNS<br>[SEQ ID NO: 277]<br>CDR3: CASSALGQSSSYNEQFF<br>[SEQ ID NO: 439] | 26 | Donor<br>D2M<br>Clone 2 |
| TRAV17*01<br>TRAJ7*01<br>CDR1: TSINN<br>[SEQ ID NO: 35]<br>CDR2: IRSNER<br>[SEQ ID NO: 197]<br>CDR3: CATDGRHGNNRLAF<br>[SEQ ID NO: 359] | TRBV25-1*01<br>TRBJ2-1*01<br>CDR1: MGHDK<br>[SEQ ID NO: 116]<br>CDR2: SYGVNS<br>[SEQ ID NO: 278]<br>CDR3: CASSDLGRGSAVNEQFF<br>[SEQ ID NO: 440] | 1 | Donor<br>D2M<br>Clone 3 |
| TRAV25*01<br>TRAJ18*01<br>CDR1: TTLSN<br>[SEQ ID NO: 36]<br>CDR2: LVKSGE<br>[SEQ ID NO: 198]<br>CDR3: CAGERGSTLGRLYF<br>[SEQ ID NO: 360] | TRBV7-9<br>TRBJ2-7*01<br>CDR1: SEHNR<br>[SEQ ID NO: 117]<br>CDR2: FQNEAQ<br>[SEQ ID NO: 279]<br>CDR3: CASSPLDRGTYEQYF<br>[SEQ ID NO: 441] | 20 | Donor<br>B31<br>Clone 1 |
| TRAV25*01<br>TRAJ18*01<br>CDR1: TTLSN<br>[SEQ ID NO: 37] | TRBV7-9<br>TRBJ2-7*01<br>CDR1: SEHNR<br>[SEQ ID NO: 118] | 1 | Donor<br>B31<br>Clone 2 |

TABLE 4-continued

α- and β-chain gene usage and CDR sequences for TCRs specific for HLA-A*24:02-TYGPVFMSL/TYGPVFMCL

| Alpha Chain: V & J gene usage and CDR sequences | Beta Chain: V & J gene usage and CDR sequences | Number of cells | Donor & Clone no. |
|---|---|---|---|
| CDR2: LVKSGE [SEQ ID NO: 199] CDR3: CAGERGSTLGRLYF [SEQ ID NO: 361] | CDR2: FQNEAQ [SEQ ID NO: 280] CDR3: CASSPLERGTYEQYF [SEQ ID NO: 442] | | |
| TRAV25*01 TRAJ18*01 CDR1: TTLSN [SEQ ID NO: 38] CDR2: LVKSGE [SEQ ID NO: 200] CDR3: CAGERGSTLGRLYF [SEQ ID NO: 362] | TRBV7-9 TRBJ2-7*01 CDR1: SEHNR [SEQ ID NO: 119] CDR2: FQNEAQ [SEQ ID NO: 281] CDR3: CASSLLSSGDYEQYF [SEQ ID NO: 443] | 1 | Donor B31 Clone 3 |
| TRAV13-1*02 TRAJ17*01 CDR1: DSASNY [SEQ ID NO: 39] CDR2: IRSNVG [SEQ ID NO: 201] CDR3: CAAPRGAAGNKLTF [SEQ ID NO: 363] | TRBV19 TRBJ2-7*01 CDR1: LNHDA [SEQ ID NO: 120] CDR2: SQIVND [SEQ ID NO: 282] CDR3: CASSKGASGMRTEQYF [SEQ ID NO: 444] | 1 | Donor B31 Clone 4 |
| TRAV25*01 TRAJ18*01 CDR1: TTLSN [SEQ ID NO: 40] CDR2: LVKSGE [SEQ ID NO: 202] CDR3: CAGERGSTLGRLYF [SEQ ID NO: 364] | TRBV24-1*01 TRBJ2-7*02 CDR1: KGHDR [SEQ ID NO: 121] CDR2: SFDVKD [SEQ ID NO: 283] CDR3: CATSDTTSTRPTEQYV [SEQ ID NO: 445] | 6 | Donor B31 Clone 5 |
| TRAV17*01 TRAJ54*01 CDR1: TSINN [SEQ ID NO: 41] CDR2: IRSNER [SEQ ID NO: 203] CDR3: CAALQGAQKLVF [SEQ ID NO: 365] | TRBV2 TRBJ2-1*01 CDR1: SNHLY [SEQ ID NO: 122] CDR2: FYNNEI [SEQ ID NO: 284] CDR3: CASSATSGSYNEQFF [SEQ ID NO: 446] | 1 | Donor B31 Clone 6 |
| TRAV4*01 TRAJ4*01 CDR1: NIATNDY [SEQ ID NO: 42] CDR2: GYKT [SEQ ID NO: 204] CDR3: CLVVPFGGYNKLIF [SEQ ID NO: 366] | TRBV29-1 TRBJ2-1 CDR1: SQVTM [SEQ ID NO: 123] CDR2: ANQGSEA [SEQ ID NO: 285] CDR3: CSVGEGTSGYESYNEQFF [SEQ ID NO: 447] | 65 | Donor Y6W Clone 1 |
| TRAV25*01 TRAJ18*01 CDR1: TTLSN [SEQ ID NO: 43] CDR2: LVKSGE [SEQ ID NO: 205] CDR3: CAGERGSTLGRLYF [SEQ ID NO: 367] | TRBV7-9 TRBJ2-7*01 CDR1: SEHNR [SEQ ID NO: 124] CDR2: FQNEAQ [SEQ ID NO: 286] CDR3: CASSSLDRGDYEQYF [SEQ ID NO: 448] | 3 | Donor Y6W Clone 2 |
| TRAV17*01 TRAJ34*01 CDR1: TSINN [SEQ ID NO: 44] CDR2: IRSNER [SEQ ID NO: 206] CDR3: CAPDRPDTDKLIF [SEQ ID NO: 368] | TRBV7-9 TRBJ2-1*01 CDR1: SEHNR [SEQ ID NO: 125] CDR2: FQNEAQ [SEQ ID NO: 287] CDR3: CASQNRREGRSEQFF [SEQ ID NO: 449] | 1 | Donor Y6W Clone 3 |

The TCR highlighted in aqua was subsequently synthetically engineered into a lentivirus expression system.

TABLE 5

α- and β-chain gene usage and CDR sequences for TCRs specific for HLA-A*24:02-PYLFWLAAI

| Alpha Chain: V & J gene usage and CDR sequences | Beta Chain: V & J gene usage and CDR sequences | Number of cells | Donor & Clone no. |
|---|---|---|---|
| TRAV25*01<br>TRAJ28*01<br>CDR1: TTLSN<br>[SEQ ID NO: 45]<br>CDR2: LVKSGE<br>[SEQ ID NO: 207]<br>CDR3: CAGPGTGAGSYQLTF<br>[SEQ ID NO: 369] | TRBV28*01<br>TRBJ2-1*01<br>CDR1: MDHEN<br>[SEQ ID NO: 126]<br>CDR2: SYDVKM<br>[SEQ ID NO: 288]<br>CDR3: CASIKSSGYNEQFF<br>[SEQ ID NO: 450] | 29 | Donor<br>B33<br>Clone 1 |
| TRAV25*01<br>TRAJ28*01<br>CDR1: TTLSN<br>[SEQ ID NO: 46]<br>CDR2: LVKSGE<br>[SEQ ID NO: 208]<br>CDR3: CAGPYSGAGSYQLTF<br>[SEQ ID NO: 370] | TRBV28*01<br>TRBJ2-1*01<br>CDR1: MDHEN<br>[SEQ ID NO: 127]<br>CDR2: SYDVKM<br>[SEQ ID NO: 289]<br>CDR3: CASILSSGYNEQFF<br>[SEQ ID NO: 451] | 65 | Donor<br>B5F<br>Clone 1 |
| TRAV4*01<br>TRAJ4*01<br>CDR1: NIATNDY<br>[SEQ ID NO: 47]<br>CDR2: GYKT<br>[SEQ ID NO: 209]<br>CDR3: CLVVPFGGYNKLIF<br>[SEQ ID NO: 371] | TRBV29-1<br>TRBJ2-1*01<br>CDR1: SQVTM<br>[SEQ ID NO: 128]<br>CDR2: ANQGSEA<br>[SEQ ID NO: 290]<br>CDR3: CSVGEGTSGYESYNEQFF<br>[SEQ ID NO: 452] | 39 | Donor<br>Y6W<br>Clone 1 |
| TRAV12-2<br>TRAJ8*01<br>CDR1: DRGSQS<br>[SEQ ID NO: 48]<br>CDR2: IYSNG<br>[SEQ ID NO: 210]<br>CDR3: CAVNVGNTGFQKLVF<br>[SEQ ID NO: 372] | TRBV30*01 or *05<br>TRBJ2-2*01<br>CDR1: GTSNPN<br>[SEQ ID NO: 129]<br>CDR2: SVGIG<br>[SEQ ID NO: 291]<br>CDR3: CACQWQGLGGELFF<br>[SEQ ID NO: 453] | 3 | Donor<br>Y6W<br>Clone 2 |
| TRAV13-1*01<br>TRAJ49*01<br>CDR1: DSASNY<br>[SEQ ID NO: 49]<br>CDR2: IRSNVG<br>[SEQ ID NO: 211]<br>CDR3: CAASEFQFYF<br>[SEQ ID NO: 373] | TRBV9*01<br>TRBJ2-2*01<br>CDR1: SGDLS<br>[SEQ ID NO: 130]<br>CDR2: YYNGEE<br>[SEQ ID NO: 292]<br>CDR3: CASSPGQRANTGELFF<br>[SEQ ID NO: 454] | 1 | Donor<br>Y6W<br>Clone 3 |
| TRAV14/DV4*02<br>TRAJ33*01<br>CDR1: TSDQSYG<br>[SEQ ID NO: 50]<br>CDR2: QGSYDEQ<br>[SEQ ID NO: 212]<br>CDR3: CAMREGVDYQLIW<br>[SEQ ID NO: 374] | TRBV10-2*01 or *03<br>TRBJ1-4*01<br>CDR1: WSHSY<br>[SEQ ID NO: 131]<br>CDR2: SAAADI<br>[SEQ ID NO: 293]<br>CDR3: CASSYENEKLFF<br>[SEQ ID NO: 455] | 1 | Donor<br>Y6W<br>Clone 4 |
| TRAV8-1*01<br>TRAJ21*01<br>CDR1: YGGTVN<br>[SEQ ID NO: 51]<br>CDR2: YFSGDPL<br>[SEQ ID NO: 213]<br>CDR3: CAVKANFNKFYF<br>[SEQ ID NO: 375] | TRBV2<br>TRBJ2-1*01<br>CDR1: SNHLY<br>[SEQ ID NO: 132]<br>CDR2: FYNNEI<br>[SEQ ID NO: 294]<br>CDR3: CASSWGNEQFF<br>[SEQ ID NO: 456] | 1 | Donor<br>Y6W<br>Clone 5 |
| TRAV12-2<br>TRAJ12*01<br>CDR1: DRGSQS<br>[SEQ ID NO: 52]<br>CDR2: IYSNG<br>[SEQ ID NO: 214] | TRBV7-2<br>TRBJ2-1*01<br>CDR1: SGHTA<br>[SEQ ID NO: 133]<br>CDR2: FQGNSA<br>[SEQ ID NO: 295] | 1 | Donor<br>Y6W<br>Clone 6 |

TABLE 5-continued

α- and β-chain gene usage and CDR sequences for TCRs specific for HLA-A*24:02-PYLFWLAAI

| Alpha Chain: V & J gene usage and CDR sequences | Beta Chain: V & J gene usage and CDR sequences | Number of cells | Donor & Clone no. |
|---|---|---|---|
| CDR3: CAAEPFSSYKLIF [SEQ ID NO: 376] | CDR3: CASSFIGGTGLNEQFF [SEQ ID NO: 457] | | |
| TRAV36/DV7*01 TRAJ54*01 CDR1: VTNFRS [SEQ ID NO: 53] CDR2: LTSSGI [SEQ ID NO: 215] CDR3: CAVESLIQGAQKLVF [SEQ ID NO: 377] | TRBV20-1 TRBJ1-4*01 CDR1: DFQATT [SEQ ID NO: 134] CDR2: SNEGSKA [SEQ ID NO: 296] CDR3: CSARDRFWGTNNEKLFF [SEQ ID NO: 458] | 1 | Donor Y6W Clone 7 |
| TRAV26-1*01 or *02 TRAJ52*01 CDR1: TISGNEY [SEQ ID NO: 54] CDR2: GLKN [SEQ ID NO: 216] CDR3: CIVRVAGGTSYGKLTF [SEQ ID NO: 378] | TRBV30*01 or *05 TRBJ1-5*01 CDR1: GTSNPN [SEQ ID NO: 135] CDR2: SVGIG [SEQ ID NO: 297] CDR3: CAWSSAPDRGHRQPQHF [SEQ ID NO: 459] | 1 | Donor Y6W Clone 8 |
| TRAV14/DV4*02 TRAJ13*02 CDR1: TSDQSYG [SEQ ID NO: 55] CDR2: QGSYDEQ [SEQ ID NO: 217] CDR3: CAMRVNSGGYQKVTF [SEQ ID NO: 379] | TRBV15*02 TRBJ2-7*01 CDR1: LNHNV [SEQ ID NO: 136] CDR2: YYDKDF [SEQ ID NO: 298] CDR3: CATSRDRGTGPPYEQYF [SEQ ID NO: 460] | 1 | Donor Y6W Clone 9 |
| TRAV12-1*01 TRAJ28*01 CDR1: NSASQS [SEQ ID NO: 56] CDR2: VYSSG [SEQ ID NO: 218] CDR3: CVLSGAGSYQLTF [SEQ ID NO: 380] | TRBV6-1*01 TRBJ2-5*01 CDR1: MNHNS [SEQ ID NO: 137] CDR2: SASEGT [SEQ ID NO: 299] CDR3: CASSEWREETQYF [SEQ ID NO: 461] | 1 | Donor Y6W Clone 10 |
| TRAV6*01 or *02 or *05 TRAJ8*01 CDR1: NYSPAY [SEQ ID NO: 57] CDR2: IRENEK [SEQ ID NO: 219] CDR3: CALDEGNTGFQKLVF [SEQ ID NO: 381] | TRBV30*01 or *05 TRBJ2-7*01 CDR1: GTSNPN [SEQ ID NO: 138] CDR2: SVGIG [SEQ ID NO: 300] CDR3: CAWSGTDSSYEQYF [SEQ ID NO: 462] | 1 | Donor Y6W Clone 11 |
| TRAV1-2*01 TRAJ8*01 CDR1: TSGFNG [SEQ ID NO: 58] CDR2: NVLDG [SEQ ID NO: 220] CDR3: RNTGFQKLVF [SEQ ID NO: 382] | TRBV28*01 TRBJ2-1*01 CDR1: MDHEN [SEQ ID NO: 139] CDR2: SYDVKM [SEQ ID NO: 301] CDR3: CASSPEQGAAGDEQFF [SEQ ID NO: 463] | 1 | Donor Y6W Clone 12 |
| TRAV8-3*01 TRAJ41*01 CDR1: YGATPY [SEQ ID NO: 59] CDR2: YFSGDTL [SEQ ID NO: 221] CDR3: CAAPGVGSNSGYALNF [SEQ ID NO: 383] | TRBV9*01 TRBJ1-6*01 CDR1: SGDLS [SEQ ID NO: 140] CDR2: YYNGEE [SEQ ID NO: 302] CDR3: CASSPSWAANSPLHF [SEQ ID NO: 464] | 1 | Donor Y6W Clone 13 |
| TRAV1-2*01 TRAJ36*01 CDR1: TSGFNG [SEQ ID NO: 60] CDR2: NVLDG [SEQ ID NO: 222] | TRBV28*01 TRBJ2-1*01 CDR1: MDHEN [SEQ ID NO: 141] CDR2: SYDVKM [SEQ ID NO: 303] | 1 | Donor Y6W Clone 14 |

TABLE 5-continued

α- and β-chain gene usage and CDR sequences for TCRs specific for HLA-A*24:02-PYLFWLAAI

| Alpha Chain: V & J gene usage and CDR sequences | Beta Chain: V & J gene usage and CDR sequences | Number of cells | Donor & Clone no. |
|---|---|---|---|
| CDR3: CAGEDQTGANNLFF [SEQ ID NO: 384] | CDR3: CASGTLSYNEQFF [SEQ ID NO: 465] | | |
| TRAV12-2 TRAJ8*01 CDR1: DRGSQS [SEQ ID NO: 61] CDR2: IYSNG [SEQ ID NO: 223] CDR3: CAVKVGTGFQKLVF [SEQ ID NO: 385] | TRBV7-9 TRBJ1-1*01 CDR1: SEHNR [SEQ ID NO: 142] CDR2: FQNEAQ [SEQ ID NO: 304] CDR3: CASSLVGQGNTEAFF [SEQ ID NO: 466] | 1 | Donor Y6W Clone 15 |

TABLE 6

α- and β-chain gene usage and CDR sequences for TCRs specific for HLA-A*02:01-YLLEMLWRL

| Alpha Chain: V & J gene usage and CDR sequences | Beta Chain: V & J gene usage and CDR sequences | Number of cells | Donor & Clone no. |
|---|---|---|---|
| TRAV8-1*01 TRAJ43*01 CDR1: YGGTVN [SEQ ID NO: 62] CDR2: YFSGDPL [SEQ ID NO: 224] CDR3: CAVSMRF [SEQ ID NO: 386] | TRBV11-2*01 TRBJ2-7*01 CDR1: SGHAT [SEQ ID NO: 143] CDR2: FQNNGV [SEQ ID NO: 305] CDR3: CASSLDEGTVTYEQYF [SEQ ID NO: 467] | 11 | Donor N2W Clone 1 |
| TRAV12-2 TRAJ53*01 CDR1: DRGSQS [SEQ ID NO: 63] CDR2: IYSNG [SEQ ID NO: 225] CDR3: CAVNPTPSVGSNYKLTF [SEQ ID NO: 387] | TRBV9*01 TRBJ1-1*01 CDR1: SGDLS [SEQ ID NO: 144] CDR2: YYNGEE [SEQ ID NO: 306] CDR3: CASSVGGEGLAFF [SEQ ID NO: 468] | 4 | Donor N2W Clone 2 |
| TRAV36/DV7*04 TRAJ26*01 CDR1: VTNFRS [SEQ ID NO: 64] CDR2: LTSSGI [SEQ ID NO: 226] CDR3: CAVAAENYGQNFVF [SEQ ID NO: 388] | TRBV7-6 TRBJ2-1*01 CDR1: SGHVS [SEQ ID NO: 145] CDR2: FNYEAQ [SEQ ID NO: 307] CDR3: CASSLEGDYNEQFF [SEQ ID NO: 469] | 3 | Donor N2W Clone 3 |
| TRAV24*01 TRAJ22*01 CDR1: SSNFYA [SEQ ID NO: 65] CDR2: MTLNGD [SEQ ID NO: 227] CDR3: CAFISSGSARQLTF [SEQ ID NO: 389] | TRBV7-6 TRBJ1-4*01 CDR1: SGHVS [SEQ ID NO: 146] CDR2: FNYEAQ [SEQ ID NO: 308] CDR3: CASSLEADNEKLFF [SEQ ID NO: 470] | 2 | Donor N2W Clone 4 |
| TRAV14/DV4*02 TRAJ50*01 CDR1: TSDQSYG [SEQ ID NO: 66] CDR2: QGSYDEQ [SEQ ID NO: 228] CDR3: CAMREDLRSNDKVIF [SEQ ID NO: 390] | TRBV9*01 TRBJ2-3*01 CDR1: SGDLS [SEQ ID NO: 147] CDR2: YYNGEE [SEQ ID NO: 309] CDR3: CASSVGDSGQAQYF [SEQ ID NO: 471] | 1 | Donor N2W Clone 5 |
| TRAV8-1*01 TRAJ42*01 CDR1: YGGTVN [SEQ ID NO: 67] | TRBV5-6*01 TRBJ2-2*01 CDR1: SGHDT [SEQ ID NO: 148] | 1 | Donor N2W Clone 6 |

TABLE 6-continued

α- and β-chain gene usage and CDR sequences for TCRs specific for HLA-A*02:01-YLLEMLWRL

| Alpha Chain: V & J gene usage and CDR sequences | Beta Chain: V & J gene usage and CDR sequences | Number of cells | Donor & Clone no. |
|---|---|---|---|
| CDR2: YFSGDPL [SEQ ID NO: 229] CDR3: CAAGGGSQGNLIF [SEQ ID NO: 391] | CDR2: YYEEEE [SEQ ID NO: 310] CDR3: CASSWWDGGTGELFF [SEQ ID NO: 472] | | |
| TRAV14/DV4*01 TRAJ20*01 CDR1: TSDPSYG [SEQ ID NO: 68] CDR2: QGSYDQQ [SEQ ID NO: 230] CDR3: CAMRELNDYKLSF [SEQ ID NO: 392] | TRBV24-1*01 TRBJ1-1*01 CDR1: KGHDR [SEQ ID NO: 149] CDR2: SFDVKD [SEQ ID NO: 311] CDR3: CATRDDLLAEAFF [SEQ ID NO: 473] | 6 | Donor B87 Clone 1 |
| TRAV17*01 TRAJ43*01 CDR1: TSINN [SEQ ID NO: 69] CDR2: IRSNER [SEQ ID NO: 231] CDR3: CATDGLPRF [SEQ ID NO: 393] | TRBV13 TRBJ2-2*01 CDR1: PRHDT [SEQ ID NO: 150] CDR2: FYEKMQ [SEQ ID NO: 312] CDR3: CASSFGTNTGELFF [SEQ ID NO: 474] | 2 | Donor B87 Clone 2 |
| TRAV8-1*01 TRAJ53*01 CDR1: YGGTVN [SEQ ID NO: 70] CDR2: YFSGDPL [SEQ ID NO: 232] CDR3: CAVNRPSGGSNYKLTF [SEQ ID NO: 394] | TRBV11-1*01 TRBJ2-1*01 CDR1: SGHAT [SEQ ID NO: 151] CDR2: FQDESV [SEQ ID NO: 313] CDR3: CASSFGQYNEQFF [SEQ ID NO: 475] | 1 | Donor B87 Clone 3 |

TABLE 7

α- and β-chain gene usage and CDR sequences for TCRs specific for HLA-A*02:01-FLYALALLL

| Alpha Chain: V & J gene usage and CDR sequences | Beta Chain: V & J gene usage and CDR sequences | Number of cells | Donor & Clone no. |
|---|---|---|---|
| TRAV17*01 TRAJ11*01 CDR1: TSINN [SEQ ID NO: 71] CDR2: IRSNER [SEQ ID NO: 233] CDR3: CATTGNSGYSTLTF [SEQ ID NO: 395] | TRBV6-5*01 TRBJ1-2*01 CDR1: MNHEY [SEQ ID NO: 152] CDR2: SVGAGI [SEQ ID NO: 314] CDR3: CASSYGGGYYGYTF [SEQ ID NO: 476] | 18 | Donor J9B Clone 1 |
| TRAV17*01 TRAJ11*01 CDR1: TSINN [SEQ ID NO: 72] CDR2: IRSNER [SEQ ID NO: 234] CDR3: CARVGDSGYSTLTF [SEQ ID NO: 396] | TRBV6-5*01 TRBJ1-2*01 CDR1: MNHEY [SEQ ID NO: 153] CDR2: SVGAGI [SEQ ID NO: 315] CDR3: CASSYQGTGAYGYTF [SEQ ID NO: 477] | 10 | Donor J9B Clone 2 |
| TRAV17*01 TRAJ11*01 CDR1: TSINN [SEQ ID NO: 73] CDR2: IRSNER [SEQ ID NO: 235] CDR3: CATEGDSGYSTLTF [SEQ ID NO: 397] | TRBV6-5*01 TRBJ1-2*01 CDR1: MNHEY [SEQ ID NO: 154] CDR2: SVGAGI [SEQ ID NO: 316] CDR3: CASSYQGGSYGYTF [SEQ ID NO: 478] | 6 | Donor A5L Clone 1 |
| TRAV17*01 TRAJ11*01 | TRBV6-5*01 TRBJ1-2*01 | 4 | Donor A5L |

TABLE 7-continued

α- and β-chain gene usage and CDR sequences for TCRs specific for HLA-A*02:01-FLYALALLL

| Alpha Chain: V & J gene usage and CDR sequences | Beta Chain: V & J gene usage and CDR sequences | Number of cells | Donor & Clone no. |
|---|---|---|---|
| CDR1: TSINN<br>[SEQ ID NO: 74]<br>CDR2: IRSNER<br>[SEQ ID NO: 236]<br>CDR3: CATEGDSGYSTLTF<br>[SEQ ID NO: 398] | CDR1: MNHEY<br>[SEQ ID NO: 155]<br>CDR2: SVGAGI<br>[SEQ ID NO: 317]<br>CDR3: CASSRQGGSYGYTF<br>[SEQ ID NO: 479] | | Clone 2 |
| TRAV17*01<br>TRAJ11*01<br>CDR1: TSINN<br>[SEQ ID NO: 75]<br>CDR2: IRSNER<br>[SEQ ID NO: 237]<br>CDR3: CATEGDSGYSTLTF<br>[SEQ ID NO: 399] | TRBV6-5*01<br>TRBJ1-2*01<br>CDR1: MNHEY<br>[SEQ ID NO: 156]<br>CDR2: SVGAGI<br>[SEQ ID NO: 318]<br>CDR3: CASSPQGGNYGYTF<br>[SEQ ID NO: 480] | 3 | Donor<br>A5L<br>Clone 3 |
| TRAV17*01<br>TRAJ11*01<br>CDR1: TSINN<br>[SEQ ID NO: 76]<br>CDR2: IRSNER<br>[SEQ ID NO: 238]<br>CDR3: CATSGDSGYSTLTF<br>[SEQ ID NO: 400] | TRBV6-5*01<br>TRBJ1-2*01<br>CDR1: MNHEY<br>[SEQ ID NO: 157]<br>CDR2: SVGAGI<br>[SEQ ID NO: 319]<br>CDR3: CASSPQGGNYGYTF<br>[SEQ ID NO: 481] | 3 | Donor<br>A5L<br>Clone 4 |
| TRAV17*01<br>TRAJ11*01<br>CDR1: TSINN<br>[SEQ ID NO: 77]<br>CDR2: IRSNER<br>[SEQ ID NO: 239]<br>CDR3: CATVGNSGYSTLTF<br>[SEQ ID NO: 401] | TRBV6-5*01<br>TRBJ2-1*01<br>CDR1: MNHEY<br>[SEQ ID NO: 158]<br>CDR2: SVGAGI<br>[SEQ ID NO: 320]<br>CDR3: CASSFQGGNEQFF<br>[SEQ ID NO: 482] | 1 | Donor<br>A5L<br>Clone 5 |
| TRAV17*01<br>TRAJ11*01<br>CDR1: TSINN<br>[SEQ ID NO: 78]<br>CDR2: IRSNER<br>[SEQ ID NO: 240]<br>CDR3: CATVGNSGYSTLTF<br>[SEQ ID NO: 402] | TRBV6-5*01<br>TRBJ1-5*01<br>CDR1: MNHEY<br>[SEQ ID NO: 159]<br>CDR2: SVGAGI<br>[SEQ ID NO: 321]<br>CDR3: CASSTQGGYQPQHF<br>[SEQ ID NO: 483] | 1 | Donor<br>A5L<br>Clone 6 |
| TRAV17*01<br>TRAJ11*01<br>CDR1: TSINN<br>[SEQ ID NO: 79]<br>CDR2: IRSNER<br>[SEQ ID NO: 241]<br>CDR3: CATVGDSGYSTLTF<br>[SEQ ID NO: 403] | TRBV6-5*01<br>TRBJ1-2*01<br>CDR1: MNHEY<br>[SEQ ID NO: 160]<br>CDR2: SVGAGI<br>[SEQ ID NO: 322]<br>CDR3: CASSRQGGIDGYTF<br>[SEQ ID NO: 484] | 1 | Donor<br>ASL<br>Clone 7 |
| TRAV17*01<br>TRAJ11*01<br>CDR1: TSINN<br>[SEQ ID NO: 80]<br>CDR2: IRSNER<br>[SEQ ID NO: 242]<br>CDR3: CATVGNSGYSTLTF<br>[SEQ ID NO: 404] | TRBV6-5*01<br>TRBJ2-1*01<br>CDR1: MNHEY<br>[SEQ ID NO: 161]<br>CDR2: SVGAGI<br>[SEQ ID NO: 323]<br>CDR3: CASSKQGGNEQFF<br>[SEQ ID NO: 485] | 1 | Donor<br>ASL<br>Clone 8 |
| TRAV17*01<br>TRAJ11*01<br>CDR1: TSINN<br>[SEQ ID NO: 81]<br>CDR2: IRSNER<br>[SEQ ID NO: 243]<br>CDR3: CATVGNSGYSTLTF<br>[SEQ ID NO: 405] | TRBV6-5*01<br>TRBJ2-1*01<br>CDR1: MNHEY<br>[SEQ ID NO: 162]<br>CDR2: SVGAGI<br>[SEQ ID NO: 324]<br>CDR3: CASSPQGGNEQFF<br>[SEQ ID NO: 486] | 1 | Donor<br>A5L<br>Clone 9 |
| TRAV17*01<br>TRAJ11*01 | TRBV6-5*01<br>TRBJ1-2*01 | 23 | Donor<br>T4W |

TABLE 7-continued

α- and β-chain gene usage and CDR sequences for TCRs specific for HLA-A*02:01-FLYALALLL

| Alpha Chain: V & J gene usage and CDR sequences | Beta Chain: V & J gene usage and CDR sequences | Number of cells | Donor & Clone no. |
|---|---|---|---|
| CDR1: TSINN [SEQ ID NO: 82] CDR2: IRSNER [SEQ ID NO: 244] CDR3: CATEGNSGYSTLTF [SEQ ID NO: 406] | CDR1: MNHEY [SEQ ID NO: 163] CDR2: SVGAGI [SEQ ID NO: 325] CDR3: CASNRQGGNYGYTF [SEQ ID NO: 487] | | Clone 1 |
| TRAV17*01 TRAJ11*01 CDR1: TSINN [SEQ ID NO: 83] CDR2: IRSNER [SEQ ID NO: 245] CDR3: CATEGDSGYSTLTF [SEQ ID NO: 407] | TRBV6-5*01 TRBJ1-2*01 CDR1: MNHEY [SEQ ID NO: 164] CDR2: SVGAGI [SEQ ID NO: 326] CDR3: CASSRQGGNYGYTF [SEQ ID NO: 488] | 11 | Donor T4W Clone 2 |
| TRAV17*01 TRAJ11*01 CDR1: TSINN [SEQ ID NO: 84] CDR2: IRSNER [SEQ ID NO: 246] CDR3: CATEGNSGYSTLTF [SEQ ID NO: 408] | TRBV6-5*01 TRBJ1-2*01 CDR1: MNHEY [SEQ ID NO: 165] CDR2: SVGAGI [SEQ ID NO: 327] CDR3: CASSQQGGDHYGYTF [SEQ ID NO: 489] | 7 | Donor T4W Clone 3 |
| TRAV17*01 TRAJ11*01 CDR1: TSINN [SEQ ID NO: 85] CDR2: IRSNER [SEQ ID NO: 247] CDR3: CATEGNSGYSTLTF [SEQ ID NO: 409] | TRBV6-5*01 TRBJ1-2*01 CDR1: MNHEY [SEQ ID NO: 166] CDR2: SVGAGI [SEQ ID NO: 328] CDR3: CASSPQGGSRGYTF [SEQ ID NO: 490] | 4 | Donor T4W Clone 4 |
| TRAV17*01 TRAJ11*01 CDR1: TSINN [SEQ ID NO: 86] CDR2: IRSNER [SEQ ID NO: 248] CDR3: CATEGDSGYSTLTF [SEQ ID NO: 410] | TRBV6-5*01 TRBJ1-2*01 CDR1: MNHEY [SEQ ID NO: 167] CDR2: SVGAGI [SEQ ID NO: 329] CDR3: CASRLQGGFNGYTF [SEQ ID NO: 491] | 1 | Donor T4W Clone 5 |
| TRAV17*01 TRAJ11*01 CDR1: TSINN [SEQ ID NO: 87] CDR2: IRSNER [SEQ ID NO: 249] CDR3: CATVGDSGYSTLTF [SEQ ID NO: 411] | TRBV6-5*01 TRBJ2-7*01 CDR1: MNHEY [SEQ ID NO: 168] CDR2: SVGAGI [SEQ ID NO: 330] CDR3: CASSVQGGAHEQYF [SEQ ID NO: 492] | 1 | Donor T4W Clone 6 |

The TCR highlighted in aqua was subsequently synthetically engineered into a lentivirus expression system.

TABLE 8

| % of individuals that have HLA allele | | | | |
|---|---|---|---|---|
| | HLA-A*24:02 | HLA-A*11:01 | HLA-B*40:01 | HLA-A*02:01 |
| Austria | 20.0% | 6.5% | 6.0% | 48.0% |
| Belgium | 12.5% | 9.4% | 12.2% | 50.0% |
| England North West | 13.8% | 13.1% | 11.4% | 50.7% |
| France Southeast | 20.0% | 8.5% | 4.6% | 38.5% |
| Hong Kong Chinese | 28.0% | 48.8% | 28.0% | 11.9% |
| Indonesian Java Western | 25.8% | 30.1% | 7.2% | 12.7% |
| Ireland South | 13.2% | 11.2% | 5.2% | 43.6% |
| Ireland Northern | 11.0% | 15.0% | 10.2% | 46.8% |
| Italy North | 11.5% | 15.4% | ? | 53.8% |
| Malaysia Peninsular Malay | 35.3% | 30.7% | 7.2% | 11.6% |
| Netherlands | 28.1% | 9.4% | 15.6% | 45.3% |
| Singapore Chinese | 28.7% | 47.7% | 28.2% | 19.5% |
| Sri Lanka Colombo | 30.3% | 76.5% | 3.4% | 6.6% |
| USA Caucasian (Bethesda) | 20.6% | 14.0% | 12.4% | 47.8% |
| USA Caucasian (Philadelphia) | 20.0% | 12.6% | 8.1% | 40.7% |
| USA African American (Bethesda) | 8.9% | 0.0% | 4.2% | 16.8% |

Reference: www.allelefrequencies.net

REFERENCES

1. Taylor, G. S., H. M. Long, J. M. Brooks, A. B. Rickinson, and A. D. Hislop, *The immunology of Epstein-Barr virus-induced disease*. Annu Rev Immunol, 2015. 33: p. 787-821.
2. Kutok, J. L. and F. Wang, *Spectrum of Epstein-Barr virus-associated diseases*. Annu Rev Pathol, 2006. 1: p. 375-404.
3. Pender, M. P. and S. R. Burrows, *Epstein-Barr virus and multiple sclerosis: potential opportunities for immunotherapy*. Clin Transl Immunology, 2014. 3(10): p. e27.
4. Davis, M. M. and P. J. Bjorkman, *T-cell antigen receptor genes and T-cell recognition*. Nature, 1988. 334(6181): p. 395-402.
5. Garboczi, D. N. and W. E. Biddison, *Shapes of MHC restriction*. Immunity, 1999. 10(1): p. 1-7.
6. Smith, C. and R. Khanna, *Adoptive therapy for EBV-induced cancers: driving success with post-transplant lymphoproliferative disorder to other EBV-derived tumors*. Immunotherapy, 2015. 7(5): p. 563-72.
7. Serafini, B., B. Rosicarelli, D. Franciotta, R. Magliozzi, R. Reynolds, P. Cinque, L. Andreoni, P. Trivedi, M. Salvetti, A. Faggioni, and F. Aloisi, *Dysregulated Epstein-Barr virus infection in the multiple sclerosis brain*. J Exp Med, 2007. 204(12): p. 2899-912.
8. Serafini, B., M. Severa, S. Columba-Cabezas, B. Rosicarelli, C. Veroni, G. Chiappetta, R. Magliozzi, R. Reynolds, E. M. Coccia, and F. Aloisi, *Epstein-Barr virus latent infection and BAFF expression in B cells in the multiple sclerosis brain: implications for viral persistence and intrathecal B-cell activation*. J Neuropathol Exp Neurol, 2010. 69(7): p. 677-93.
9. Karpanen, T. and J. Olweus, *T-cell receptor gene therapy—ready to go viral*?Mol Oncol, 2015. 9(10): p. 2019-42.
10. Garber, K., *Driving T-cell immunotherapy to solid tumors*. Nat Biotechnol, 2018. 36(3): p. 215-219.
11. Zheng, Y., G. Parsonage, X. Zhuang, L. R. Machado, C. H. James, A. Salman, P. F. Searle, E. P. Hui, A. T. Chan, and S. P. Lee, *Human Leukocyte Antigen (HLA) A*1101-Restricted Epstein-Barr Virus-Specific T-cell Receptor Gene Transfer to Target Nasopharyngeal Carcinoma*. Cancer Immunol Res, 2015. 3(10): p. 1138-47.
12. Jurgens, L. A., R. Khanna, J. Weber, and R. J. Orentas, *Transduction of primary lymphocytes with Epstein-Barr virus (EBV) latent membrane protein-specific T-cell receptor induces lysis of virus-infected cells: A novel strategy for the treatment of Hodgkin's disease and nasopharyngeal carcinoma*. J Clin Immunol, 2006. 26(1): p. 22-32.
13. Ikeda, H., *T-cell adoptive immunotherapy using tumor-infiltrating T cells and genetically engineered TCR-T cells*. Int Immunol, 2016. 28(7): p. 349-53.
14. Nguyen, T. H., L. C. Rowntree, D. G. Pellicci, N. L. Bird, A. Handel, L. Kjer-Nielsen, K. Kedzierska, T. C. Kotsimbos, and N. A. Mifsud, *Recognition of distinct cross-reactive virus-specific CD8+ T cells reveals a unique TCR signature in a clinical setting*. J Immunol, 2014. 192(11): p. 5039-49.
15. Cohen, C. J., Y. F. Li, M. El-Gamil, P. F. Robbins, S. A. Rosenberg, and R. A. Morgan, *Enhanced antitumor activity of T cells engineered to express T-cell receptors with a second disulfide bond*. Cancer Res, 2007. 67(8): p. 3898-903.
16. Sommenneyer, D. and W. Uckert, *Minimal amino acid exchange in human TCR constant regions fosters improved function of TCR gene-modified T cells*. J Immunol, 2010. 184(11): p. 6223-31.
17. Lee, S. P., R. J. Tierney, W. A. Thomas, J. M. Brooks, and A. B. Rickinson, *Conserved CTL epitopes within EBV latent membrane protein 2: a potential target for CTL-based tumor therapy*. J Immunol, 1997. 158(7): p. 3325-34.
18. Burrows, S. R., R. A. Elkington, J. J. Miles, K. J. Green, S. Walker, S. M. Haryana, D. J. Moss, H. Dunckley, J. M. Burrows, and R. Khanna, *Promiscuous CTL recognition of viral epitopes on multiple human leukocyte antigens: biological validation of the proposed HLA A24 supertype*. The Journal of Immunology, 2003. 171(3): p. 1407-1412.
19. Khanna, R., S. R. Burrows, J. Nicholls, and L. M. Poulsen, *Identification of cytotoxic T cell epitopes within Epstein-Barr virus (EBV) oncogene latent membrane protein 1 (LMP1): evidence for HLA A2 supertype-restricted immune recognition of EBV-infected cells by LMP1-specific cytotoxic T lymphocytes*. Eur J Immunol, 1998. 28(2): p. 451-8.

SEQUENCE LISTING (816 sequences)

SEQ ID NO: 1 - protein, 9 aa, Epstein-Barr virus
IEDPPFNSL

SEQ ID NO: 2 - protein, 10 aa, Epstein-Barr virus
SSCSSCPLSK

SEQ ID NO: 3 - protein, 9 aa, Epstein-Barr virus
TYGPVFMSL

SEQ ID NO: 4 - protein, 9 aa, Epstein-Barr virus
PYLFWLAAI

SEQ ID NO: 5 - protein, 9 aa, Epstein-Barr virus
YLLEMLWRL

SEQ ID NO: 6 - protein, 9 aa, Epstein-Barr virus
FLYALALLL

SEQ ID NO: 7 - protein, 6 aa, Homo sapiens
DSAIYN

SEQ ID NO: 8 - protein, 6 aa, Homo sapiens
TSGFNG

SEQ ID NO: 9 - protein, 7 aa, Homo sapiens
TRDTTYY

SEQ ID NO: 10 - protein, 7 aa, Homo sapiens
TISGTDY

SEQ ID NO: 11 - protein, 5 aa, Homo sapiens
SIFNT

SEQ ID NO: 12 - protein, 6 aa, Homo sapiens
TSGFYG

SEQ ID NO: 13 - protein, 6 aa, Homo sapiens
YSGSPE

SEQ ID NO: 14 - protein, 6 aa, Homo sapiens
TSGFNG

SEQ ID NO: 15 - protein, 6 aa, Homo sapiens
SSNFYA

SEQ ID NO: 16 - protein, 6 aa, Homo sapiens
TSGFYG

SEQ ID NO: 17 - protein, 7 aa, Homo sapiens
TSENNYY

SEQ ID NO: 18 - protein, 6 aa, Homo sapiens
DSAIYN

SEQ ID NO: 19 - protein, 6 aa, Homo sapiens
DSAIYN

SEQ ID NO: 20 - protein, 5 aa, Homo sapiens
DSVNN

SEQ ID NO: 21 - protein, 6 aa, Homo sapiens
VSGNPY

SEQ ID NO: 22 - protein, 6 aa, Homo sapiens
SSYSPS

SEQ ID NO: 23 - protein, 5 aa, Homo sapiens
DSVNN

SEQ ID NO: 24 - protein, 5 aa, Homo sapiens
DSVNN

SEQ ID NO: 25 - protein, 6 aa, Homo sapiens
NSASDY

SEQ ID NO: 26 - protein, 6 aa, Homo sapiens
NSMFDY

SEQ ID NO: 27 - protein, 6 aa, Homo sapiens
TSGFNG

SEQ ID NO: 28 - protein, 6 aa, Homo sapiens
TSGFYG

SEQ ID NO: 29 - protein, 6 aa, Homo sapiens
DSAIYN

SEQ ID NO: 30 - protein, 5 aa, Homo sapiens
TTLSN

SEQ ID NO: 31 - protein, 7 aa, Homo sapiens
TSDQSYG

SEQ ID NO: 32 - protein, 6 aa, Homo sapiens
NSMFDY

SEQ ID NO: 33 - protein, 5 aa, Homo sapiens
TSINN

SEQ ID NO: 34 - protein, 5 aa, Homo sapiens
TSINN

SEQ ID NO: 35 - protein, 5 aa, Homo sapiens
TSINN

SEQ ID NO: 36 - protein, 5 aa, Homo sapiens
TTLSN

SEQ ID NO: 37 - protein, 5 aa, Homo sapiens
TTLSN

SEQ ID NO: 38 - protein, 5 aa, Homo sapiens
TTLSN

SEQ ID NO: 39 - protein, 6 aa, Homo sapiens
DSASNY

SEQ ID NO: 40 - protein, 5 aa, Homo sapiens
TTLSN

SEQ ID NO: 41 - protein, 5 aa, Homo sapiens
TSINN

SEQ ID NO: 42 - protein, 7 aa, Homo sapiens
NIATNDY

SEQ ID NO: 43 - protein, 5 aa, Homo sapiens
TTLSN

SEQ ID NO: 44 - protein, 5 aa, Homo sapiens
TSINN

SEQ ID NO: 45 - protein, 5 aa, Homo sapiens
TTLSN

SEQ ID NO: 46 - protein, 5 aa, Homo sapiens
TTLSN

SEQ ID NO: 47 - protein, 7 aa, Homo sapiens
NIATNDY

SEQ ID NO: 48 - protein, 6 aa, Homo sapiens
DRGSQS

SEQ ID NO: 49 - protein, 6 aa, Homo sapiens
DSASNY

SEQ ID NO: 50 - protein, 7 aa, Homo sapiens
TSDQSYG

SEQ ID NO: 51 - protein, 6 aa, Homo sapiens
YGGTVN

SEQ ID NO: 52 - protein, 6 aa, Homo sapiens
DRGSQS

SEQ ID NO: 53 - protein, 6 aa, Homo sapiens
VTNFRS

SEQ ID NO: 54 - protein, 7 aa, Homo sapiens
TISGNEY

SEQ ID NO: 55 - protein, 7 aa, Homo sapiens
TSDQSYG

SEQ ID NO: 56 - protein, 6 aa, Homo sapiens
NSASQS

SEQ ID NO: 57 - protein, 6 aa, Homo sapiens
NYSPAY

SEQ ID NO: 58 - protein, 6 aa, Homo sapiens
TSGFNG

SEQ ID NO: 59 - protein, 6 aa, Homo sapiens
YGATPY

SEQ ID NO: 60 - protein, 6 aa, Homo sapiens
TSGFNG

SEQ ID NO: 61 - protein, 6 aa, Homo sapiens
DRGSQS

SEQ ID NO: 62 - protein, 6 aa, Homo sapiens
YGGTVN

SEQ ID NO: 63 - protein, 6 aa, Homo sapiens
DRGSQS

SEQ ID NO: 64 - protein, 6 aa, Homo sapiens
VTNFRS

SEQ ID NO: 65 - protein, 6 aa, Homo sapiens
SSNFYA

SEQ ID NO: 66 - protein, 7 aa, Homo sapiens
TSDQSYG

SEQ ID NO: 67 - protein, 6 aa, Homo sapiens
YGGTVN

SEQ ID NO: 68 - protein, 7 aa, Homo sapiens
TSDPSYG

SEQ ID NO: 69 - protein, 5 aa, Homo sapiens
TSINN

SEQ ID NO: 70 - protein, 6 aa, Homo sapiens
YGGTVN

SEQ ID NO: 71 - protein, 5 aa, Homo sapiens
TSINN

SEQ ID NO: 72 - protein, 5 aa, Homo sapiens
TSINN

SEQ ID NO: 73 - protein, 5 aa, Homo sapiens
TSINN

SEQ ID NO: 74 - protein, 5 aa, Homo sapiens
TSINN

SEQ ID NO: 75 - protein, 5 aa, Homo sapiens
TSINN

SEQ ID NO: 76 - protein, 5 aa, Homo sapiens
TSINN

SEQ ID NO: 77 - protein, 5 aa, Homo sapiens
TSINN

SEQ ID NO: 78 - protein, 5 aa, Homo sapiens
TSINN

SEQ ID NO: 79 - protein, 5 aa, Homo sapiens
TSINN

SEQ ID NO: 80 - protein, 5 aa, Homo sapiens
TSINN

SEQ ID NO: 81 - protein, 5 aa, Homo sapiens
TSINN

SEQ ID NO: 82 - protein, 5 aa, Homo sapiens
TSINN

SEQ ID NO: 83 - protein, 5 aa, Homo sapiens
TSINN

SEQ ID NO: 84 - protein, 5 aa, Homo sapiens
TSINN

SEQ ID NO: 85 - protein, 5 aa, Homo sapiens
TSINN

SEQ ID NO: 86 - protein, 5 aa, Homo sapiens
TSINN

SEQ ID NO: 87 - protein, 5 aa, Homo sapiens
TSINN

SEQ ID NO: 88 - protein, 5 aa, Homo sapiens
MNHEY

SEQ ID NO: 89 - protein, 5 aa, Homo sapiens
SGDLS

SEQ ID NO: 90 - protein, 5 aa, Homo sapiens
MGHRA

SEQ ID NO: 91 - protein, 5 aa, Homo sapiens
MNHEY

SEQ ID NO: 92 - protein, 5 aa, Homo sapiens
MNHEY

SEQ ID NO: 93 - protein, 6 aa, Homo sapiens
DFQATT

SEQ ID NO: 94 - protein, 5 aa, Homo sapiens
MNHEY

SEQ ID NO: 95 - protein, 5 aa, Homo sapiens
SGDLS

SEQ ID NO: 96 - protein, 5 aa, Homo sapiens
MNHEY

SEQ ID NO: 97 - protein, 6 aa, Homo sapiens
DFQATT

SEQ ID NO: 98 - protein, 5 aa, Homo sapiens
MGHRA

SEQ ID NO: 99 - protein, 5 aa, Homo sapiens
MNHEY

SEQ ID NO: 100 - protein, 5 aa, Homo sapiens
MDHEN

SEQ ID NO: 101 - protein, 5 aa, Homo sapiens
SGDLS

SEQ ID NO: 102 - protein, 6 aa, Homo sapiens
GTSNPN

SEQ ID NO: 103 - protein, 5 aa, Homo sapiens
SNHLY

SEQ ID NO: 104 - protein, 5 aa, Homo sapiens
SGDLS

SEQ ID NO: 105 - protein, 5 aa, Homo sapiens
SGDLS

SEQ ID NO: 106 - protein, 5 aa, Homo sapiens
MNHEY

SEQ ID NO: 107 - protein, 5 aa, Homo sapiens
ENHRY

SEQ ID NO: 108 - protein, 5 aa, Homo sapiens
MRHNA

SEQ ID NO: 109 - protein, 5 aa, Homo sapiens
MNHEY

SEQ ID NO: 110 - protein, 5 aa, Homo sapiens
SGDLS

SEQ ID NO: 111 - protein, 5 aa, Homo sapiens
LNHDA

SEQ ID NO: 112 - protein, 6 aa, Homo sapiens
GTSNPN

SEQ ID NO: 113 - protein, 5 aa, Homo sapiens
SGHAT

SEQ ID NO: 114 - protein, 5 aa, Homo sapiens
MGHDK

SEQ ID NO: 115 - protein, 5 aa, Homo sapiens
MGHDK

SEQ ID NO: 116 - protein, 5 aa, Homo sapiens
MGHDK

SEQ ID NO: 117 - protein, 5 aa, Homo sapiens
SEHNR

SEQ ID NO: 118 - protein, 5 aa, Homo sapiens
SEHNR

SEQ ID NO: 119 - protein, 5 aa, Homo sapiens
SEHNR

SEQ ID NO: 120 - protein, 5 aa, Homo sapiens
LNHDA

SEQ ID NO: 121 - protein, 5 aa, Homo sapiens
KGHDR

SEQ ID NO: 122 - protein, 5 aa, Homo sapiens
SNHLY

SEQ ID NO: 123 - protein, 5 aa, Homo sapiens
SQVTM

SEQ ID NO: 124 - protein, 5 aa, Homo sapiens
SEHNR

SEQ ID NO: 125 - protein, 5 aa, Homo sapiens
SEHNR

SEQ ID NO: 126 - protein, 5 aa, Homo sapiens
MDHEN

SEQ ID NO: 127 - protein, 5 aa, Homo sapiens
MDHEN

SEQ ID NO: 128 - protein, 5 aa, Homo sapiens
SQVTM

SEQ ID NO: 129 - protein, 6 aa, Homo sapiens
GTSNPN

SEQ ID NO: 130 - protein, 5 aa, Homo sapiens
SGDLS

SEQ ID NO: 131 - protein, 5 aa, Homo sapiens
WSHSY

SEQ ID NO: 132 - protein, 5 aa, Homo sapiens
SNHLY

SEQ ID NO: 133 - protein, 5 aa, Homo sapiens
SGHTA

SEQ ID NO: 134 - protein, 6 aa, Homo sapiens
DFQATT

SEQ ID NO: 135 - protein, 6 aa, Homo sapiens
GTSNPN

SEQ ID NO: 136 - protein, 5 aa, Homo sapiens
LNHNV

SEQ ID NO: 137 - protein, 5 aa, Homo sapiens
MNHNS

SEQ ID NO: 138 - protein, 6 aa, Homo sapiens
GTSNPN

SEQ ID NO: 139 - protein, 5 aa, Homo sapiens
MDHEN

SEQ ID NO: 140 - protein, 5 aa, Homo sapiens
SGDLS

SEQ ID NO: 141 - protein, 5 aa, Homo sapiens
MDHEN

SEQ ID NO: 142 - protein, 5 aa, Homo sapiens
SEHNR

SEQ ID NO: 143 - protein, 5 aa, Homo sapiens
SGHAT

SEQ ID NO: 144 - protein, 5 aa, Homo sapiens
SGDLS

SEQ ID NO: 145 - protein, 5 aa, Homo sapiens
SGHVS

SEQ ID NO: 146 - protein, 5 aa, Homo sapiens
SGHVS

SEQ ID NO: 147 - protein, 5 aa, Homo sapiens
SGDLS

SEQ ID NO: 148 - protein, 5 aa, Homo sapiens
SGHDT

SEQ ID NO: 149 - protein, 5 aa, Homo sapiens
KGHDR

SEQ ID NO: 150 - protein, 5 aa, Homo sapiens
PRHDT

SEQ ID NO: 151 - protein, 5 aa, Homo sapiens
SGHAT

SEQ ID NO: 152 - protein, 5 aa, Homo sapiens
MNHEY

SEQ ID NO: 153 - protein, 5 aa, Homo sapiens
MNHEY

SEQ ID NO: 154 - protein, 5 aa, Homo sapiens
MNHEY

SEQ ID NO: 155 - protein, 5 aa, Homo sapiens
MNHEY

SEQ ID NO: 156 - protein, 5 aa, Homo sapiens
MNHEY

SEQ ID NO: 157 - protein, 5 aa, Homo sapiens
MNHEY

SEQ ID NO: 158 - protein, 5 aa, Homo sapiens
MNHEY

SEQ ID NO: 159 - protein, 5 aa, Homo sapiens
MNHEY

SEQ ID NO: 160 - protein, 5 aa, Homo sapiens
MNHEY

SEQ ID NO: 161 - protein, 5 aa, Homo sapiens
MNHEY

SEQ ID NO: 162 - protein, 5 aa, Homo sapiens
MNHEY

SEQ ID NO: 163 - protein, 5 aa, Homo sapiens
MNHEY

SEQ ID NO: 164 - protein, 5 aa, Homo sapiens
MNHEY

SEQ ID NO: 165 - protein, 5 aa, Homo sapiens
MNHEY

SEQ ID NO: 166 - protein, 5 aa, Homo sapiens
MNHEY

SEQ ID NO: 167 - protein, 5 aa, Homo sapiens
MNHEY

SEQ ID NO: 168 - protein, 5 aa, Homo sapiens
MNHEY

SEQ ID NO: 169 - protein, 7 aa, Homo sapiens
IQSSQRE

SEQ ID NO: 170 - protein, 5 aa, Homo sapiens
NVLDG

SEQ ID NO: 171 - protein, 7 aa, Homo sapiens
RNSFDEQ

SEQ ID NO: 172 - protein, 4 aa, Homo sapiens
GLTS

SEQ ID NO: 173 - protein, 6 aa, Homo sapiens
LYKAGE

SEQ ID NO: 174 - protein, 5 aa, Homo sapiens
NALDG

SEQ ID NO: 175 - protein, 3 aa, Homo sapiens
HIS

SEQ ID NO: 176 - protein, 5 aa, Homo sapiens
NVLDG

SEQ ID NO: 177 - protein, 6 aa, Homo sapiens
MTLNGD

SEQ ID NO: 178 - protein, 5 aa, Homo sapiens
NALDG

SEQ ID NO: 179 - protein, 7 aa, Homo sapiens
QEAYKQQ

SEQ ID NO: 180 - protein, 7 aa, Homo sapiens
IQSSQRE

SEQ ID NO: 181 - protein, 7 aa, Homo sapiens
IQSSQRE

SEQ ID NO: 182 - protein, 4 aa, Homo sapiens
IPSG

SEQ ID NO: 183 - protein, 8 aa, Homo sapiens
YITGDNLV

SEQ ID NO: 184 - protein, 7 aa, Homo sapiens
YTSAATL

SEQ ID NO: 185 - protein, 4 aa, Homo sapiens
IPSG

SEQ ID NO: 186 - protein, 4 aa, Homo sapiens
IPSG

SEQ ID NO: 187 - protein, 6 aa, Homo sapiens
IRSNMD

SEQ ID NO: 188 - protein, 7 aa, Homo sapiens
ISSIKDK

SEQ ID NO: 189 - protein, 5 aa, Homo sapiens
NVLDG

SEQ ID NO: 190 - protein, 5 aa, Homo sapiens
NALDG

SEQ ID NO: 191 - protein, 7 aa, Homo sapiens
IQSSQRE

SEQ ID NO: 192 - protein, 6 aa, Homo sapiens
LVKSGE

SEQ ID NO: 193 - protein, 7 aa, Homo sapiens
QGSYDEQ

SEQ ID NO: 194 - protein, 7 aa, Homo sapiens
ISSIKDK

SEQ ID NO: 195 - protein, 6 aa, Homo sapiens
IRSNER

SEQ ID NO: 196 - protein, 6 aa, Homo sapiens
IRSNER

SEQ ID NO: 197 - protein, 6 aa, Homo sapiens
IRSNER

SEQ ID NO: 198 - protein, 6 aa, Homo sapiens
LVKSGE

SEQ ID NO: 199 - protein, 6 aa, Homo sapiens
LVKSGE

SEQ ID NO: 200 - protein, 6 aa, Homo sapiens
LVKSGE

SEQ ID NO: 201 - protein, 6 aa, Homo sapiens
IRSNVG

SEQ ID NO: 202 - protein, 6 aa, Homo sapiens
LVKSGE

SEQ ID NO: 203 - protein, 6 aa, Homo sapiens
IRSNER

SEQ ID NO: 204 - protein, 4 aa, Homo sapiens
GYKT

SEQ ID NO: 205 - protein, 6 aa, Homo sapiens
LVKSGE

SEQ ID NO: 206 - protein, 6 aa, Homo sapiens
IRSNER

SEQ ID NO: 207 - protein, 6 aa, Homo sapiens
LVKSGE

SEQ ID NO: 208 - protein, 6 aa, Homo sapiens
LVKSGE

SEQ ID NO: 209 - protein, 4 aa, Homo sapiens
GYKT

SEQ ID NO: 210 - protein, 5 aa, Homo sapiens
IYSNG

SEQ ID NO: 211 - protein, 6 aa, Homo sapiens
IRSNVG

SEQ ID NO: 212 - protein, 7 aa, Homo sapiens
QGSYDEQ

SEQ ID NO: 213 - protein, 7 aa, Homo sapiens
YFSGDPL

SEQ ID NO: 214 - protein, 5 aa, Homo sapiens
IYSNG

SEQ ID NO: 215 - protein, 6 aa, Homo sapiens
LTSSGI

SEQ ID NO: 216 - protein, 4 aa, Homo sapiens
GLKN

SEQ ID NO: 217 - protein, 7 aa, Homo sapiens
QGSYDEQ

SEQ ID NO: 218 - protein, 5 aa, Homo sapiens
VYSSG

SEQ ID NO: 219 - protein, 6 aa, Homo sapiens
IRENEK

SEQ ID NO: 220 - protein, 5 aa, Homo sapiens
NVLDG

SEQ ID NO: 221 - protein, 7 aa, Homo sapiens
YFSGDTL

SEQ ID NO: 222 - protein, 5 aa, Homo sapiens
NVLDG

SEQ ID NO: 223 - protein, 5 aa, Homo sapiens
IYSNG

SEQ ID NO: 224 - protein, 7 aa, Homo sapiens
YFSGDPL

SEQ ID NO: 225 - protein, 5 aa, Homo sapiens
IYSNG

SEQ ID NO: 226 - protein, 6 aa, Homo sapiens
LTSSGI

SEQ ID NO: 227 - protein, 6 aa, Homo sapiens
MTLNGD

SEQ ID NO: 228 - protein, 7 aa, Homo sapiens
QGSYDEQ

SEQ ID NO: 229 - protein, 7 aa, Homo sapiens
YFSGDPL

SEQ ID NO: 230 - protein, 7 aa, Homo sapiens
QGSYDQQ

SEQ ID NO: 231 - protein, 6 aa, Homo sapiens
IRSNER

SEQ ID NO: 232 - protein, 7 aa, Homo sapiens
YFSGDPL

SEQ ID NO: 233 - protein, 6 aa, Homo sapiens
IRSNER

SEQ ID NO: 234 - protein, 6 aa, Homo sapiens
IRSNER

SEQ ID NO: 235 - protein, 6 aa, Homo sapiens
IRSNER

SEQ ID NO: 236 - protein, 6 aa, Homo sapiens
IRSNER

SEQ ID NO: 237 - protein, 6 aa, Homo sapiens
IRSNER

SEQ ID NO: 238 - protein, 6 aa, Homo sapiens
IRSNER

SEQ ID NO: 239 - protein, 6 aa, Homo sapiens
IRSNER

SEQ ID NO: 240 - protein, 6 aa, Homo sapiens
IRSNER

SEQ ID NO: 241 - protein, 6 aa, Homo sapiens
IRSNER

SEQ ID NO: 242 - protein, 6 aa, Homo sapiens
IRSNER

SEQ ID NO: 243 - protein, 6 aa, Homo sapiens
IRSNER

SEQ ID NO: 244 - protein, 6 aa, Homo sapiens
IRSNER

SEQ ID NO: 245 - protein, 6 aa, Homo sapiens
IRSNER

SEQ ID NO: 246 - protein, 6 aa, Homo sapiens
IRSNER

SEQ ID NO: 247 - protein, 6 aa, Homo sapiens
IRSNER

SEQ ID NO: 248 - protein, 6 aa, Homo sapiens
IRSNER

SEQ ID NO: 249 - protein, 6 aa, Homo sapiens
IRSNER

SEQ ID NO: 250 - protein, 6 aa, Homo sapiens
SMNVEV

SEQ ID NO: 251 - protein, 6 aa, Homo sapiens
YYNGEE

SEQ ID NO: 252 - protein, 6 aa, Homo sapiens
YSYEKL

SEQ ID NO: 253 - protein, 6 aa, Homo sapiens
SMNVEV

SEQ ID NO: 254 - protein, 6 aa, Homo sapiens
SMNVEV

SEQ ID NO: 255 - protein, 7 aa, Homo sapiens
SNEGSKA

SEQ ID NO: 256 - protein, 6 aa, Homo sapiens
SMNVEV

SEQ ID NO: 257 - protein, 6 aa, Homo sapiens
YYNGEE

SEQ ID NO: 258 - protein, 6 aa, Homo sapiens
SMNVEV

SEQ ID NO: 259 - protein, 7 aa, Homo sapiens
SNEGSKA

SEQ ID NO: 260 - protein, 6 aa, Homo sapiens
YSYEKL

SEQ ID NO: 261 - protein, 6 aa, Homo sapiens
SMNVEV

SEQ ID NO: 262 - protein, 6 aa, Homo sapiens
SYDVKM

SEQ ID NO: 263 - protein, 6 aa, Homo sapiens
YYNGEE

SEQ ID NO: 264 - protein, 5 aa, Homo sapiens
SVGIG

SEQ ID NO: 265 - protein, 6 aa, Homo sapiens
FYNNEI

SEQ ID NO: 266 - protein, 6 aa, Homo sapiens
YYNGEE

SEQ ID NO: 267 - protein, 6 aa, Homo sapiens
YYNGEE

SEQ ID NO: 268 - protein, 6 aa, Homo sapiens
SMNVEV

SEQ ID NO: 269 - protein, 6 aa, Homo sapiens
SYGVKD

SEQ ID NO: 270 - protein, 6 aa, Homo sapiens
SNTAGT

SEQ ID NO: 271 - protein, 6 aa, Homo sapiens
SMNVEV

SEQ ID NO: 272 - protein, 6 aa, Homo sapiens
YYNGEE

SEQ ID NO: 273 - protein, 6 aa, Homo sapiens
SQIVND

SEQ ID NO: 274 - protein, 5 aa, Homo sapiens
SVGIG

SEQ ID NO: 275 - protein, 6 aa, Homo sapiens
FQNNGV

SEQ ID NO: 276 - protein, 6 aa, Homo sapiens
SYGVNS

SEQ ID NO: 277 - protein, 6 aa, Homo sapiens
SYGVNS

SEQ ID NO: 278 - protein, 6 aa, Homo sapiens
SYGVNS

SEQ ID NO: 279 - protein, 6 aa, Homo sapiens
FQNEAQ

SEQ ID NO: 280 - protein, 6 aa, Homo sapiens
FQNEAQ

SEQ ID NO: 281 - protein, 6 aa, Homo sapiens
FQNEAQ

SEQ ID NO: 282 - protein, 6 aa, Homo sapiens
SQIVND

SEQ ID NO: 283 - protein, 6 aa, Homo sapiens
SFDVKD

SEQ ID NO: 284 - protein, 6 aa, Homo sapiens
FYNNEI

SEQ ID NO: 285 - protein, 7 aa, Homo sapiens
ANQGSEA

SEQ ID NO: 286 - protein, 6 aa, Homo sapiens
FQNEAQ

SEQ ID NO: 287 - protein, 6 aa, Homo sapiens
FQNEAQ

SEQ ID NO: 288 - protein, 6 aa, Homo sapiens
SYDVKM

SEQ ID NO: 289 - protein, 6 aa, Homo sapiens
SYDVKM

SEQ ID NO: 290 - protein, 7 aa, Homo sapiens
ANQGSEA

SEQ ID NO: 291 - protein, 5 aa, Homo sapiens
SVGIG

SEQ ID NO: 292 - protein, 6 aa, Homo sapiens
YYNGEE

SEQ ID NO: 293 - protein, 6 aa, Homo sapiens
SAAADI

SEQ ID NO: 294 - protein, 6 aa, Homo sapiens
FYNNEI

SEQ ID NO: 295 - protein, 6 aa, Homo sapiens
FQGNSA

SEQ ID NO: 296 - protein, 7 aa, Homo sapiens
SNEGSKA

SEQ ID NO: 297 - protein, 5 aa, Homo sapiens
SVGIG

SEQ ID NO: 298 - protein, 6 aa, Homo sapiens
YYDKDF

SEQ ID NO: 299 - protein, 6 aa, Homo sapiens
SASEGT

SEQ ID NO: 300 - protein, 5 aa, Homo sapiens
SVGIG

SEQ ID NO: 301 - protein, 6 aa, Homo sapiens
SYDVKM

SEQ ID NO: 302 - protein, 6 aa, Homo sapiens
YYNGEE

SEQ ID NO: 303 - protein, 6 aa, Homo sapiens
SYDVKM

SEQ ID NO: 304 - protein, 6 aa, Homo sapiens
FQNEAQ

SEQ ID NO: 305 - protein, 6 aa, Homo sapiens
FQNNGV

SEQ ID NO: 306 - protein, 6 aa, Homo sapiens
YYNGEE

SEQ ID NO: 307 - protein, 6 aa, Homo sapiens
FNYEAQ

SEQ ID NO: 308 - protein, 6 aa, Homo sapiens
FNYEAQ

SEQ ID NO: 309 - protein, 6 aa, Homo sapiens
YYNGEE

SEQ ID NO: 310 - protein, 6 aa, Homo sapiens
YYEEEE

SEQ ID NO: 311 - protein, 6 aa, Homo sapiens
SFDVKD

SEQ ID NO: 312 - protein, 6 aa, Homo sapiens
FYEKMQ

SEQ ID NO: 313 - protein, 6 aa, Homo sapiens
FQDESV

SEQ ID NO: 314 - protein, 6 aa, Homo sapiens
SVGAGI

SEQ ID NO: 315 - protein, 6 aa, Homo sapiens
SVGAGI

SEQ ID NO: 316 - protein, 6 aa, Homo sapiens
SVGAGI

SEQ ID NO: 317 - protein, 6 aa, Homo sapiens
SVGAGI

SEQ ID NO: 318 - protein, 6 aa, Homo sapiens
SVGAGI

SEQ ID NO: 319 - protein, 6 aa, Homo sapiens
SVGAGI

SEQ ID NO: 320 - protein, 6 aa, Homo sapiens
SVGAGI

SEQ ID NO: 321 - protein, 6 aa, Homo sapiens
SVGAGI

SEQ ID NO: 322 - protein, 6 aa, Homo sapiens
SVGAGI

SEQ ID NO: 323 - protein, 6 aa, Homo sapiens
SVGAGI

SEQ ID NO: 324 - protein, 6 aa, Homo sapiens
SVGAGI

SEQ ID NO: 325 - protein, 6 aa, Homo sapiens
SVGAGI

SEQ ID NO: 326 - protein, 6 aa, Homo sapiens
SVGAGI

SEQ ID NO: 327 - protein, 6 aa, Homo sapiens
SVGAGI

SEQ ID NO: 328 - protein, 6 aa, Homo sapiens
SVGAGI

SEQ ID NO: 329 - protein, 6 aa, Homo sapiens
SVGAGI

SEQ ID NO: 330 - protein, 6 aa, Homo sapiens
SVGAGI

SEQ ID NO: 331 - protein, 14 aa, Homo sapiens
CAVYSGAGSYQLTF

SEQ ID NO: 332 - protein, 14 aa, Homo sapiens
CAVGGNTGGFKTIF

SEQ ID NO: 333 - protein, 15 aa, Homo sapiens
CALSEARGSQGNLIF

SEQ ID NO: 334 - protein, 14 aa, Homo sapiens
CILRDVTGGFKTIF

SEQ ID NO: 335 - protein, 14 aa, Homo sapiens
CAGRGSYNFNKFYF

SEQ ID NO: 336 - protein, 10 aa, Homo sapiens
CASSEGKLIF

SEQ ID NO: 337 - protein, 14 aa, Homo sapiens
CALRWQTGANNLFF

SEQ ID NO: 338 - protein, 14 aa, Homo sapiens
CAVNGGTGGFKTIF

SEQ ID NO: 339 - protein, 13 aa, Homo sapiens
CASPRTGFQKLVF

SEQ ID NO: 340 - protein, 10 aa, Homo sapiens
CASTEGKLIF

SEQ ID NO: 341 - protein, 15 aa, Homo sapiens
CAFMTVYNQGGKLIF

SEQ ID NO: 342 - protein, 14 aa, Homo sapiens
CAPYSGAGAYQLTF

SEQ ID NO: 343 - protein, 15 aa, Homo sapiens
CAVWAGGTSYGKLTF

SEQ ID NO: 344 - protein, 11 aa, Homo sapiens
CAVVINNDMRF

SEQ ID NO: 345 - protein, 14 aa, Homo sapiens
CAVREASGANNLFF

SEQ ID NO: 346 - protein, 16 aa, Homo sapiens
CVVSYLGDTGRRALTF

SEQ ID NO: 347 - protein, 11 aa, Homo sapiens
CAVVGNNDMRF

SEQ ID NO: 348 - protein, 11 aa, Homo sapiens
CAVLNNNDMRF

SEQ ID NO: 349 - protein, 13 aa, Homo sapiens
CAETPGGYQKVTF

SEQ ID NO: 350 - protein, 12 aa, Homo sapiens
CAASAGGQNFVF

SEQ ID NO: 351 - protein, 12 aa, Homo sapiens
CAVKDSNYQLIW

SEQ ID NO: 352 - protein, 14 aa, Homo sapiens
CAVPRRNNNARLMF

SEQ ID NO: 353 - protein, 17 aa, Homo sapiens
CAVGGDDSGAGSYQLTF

SEQ ID NO: 354 - protein, 15 aa, Homo sapiens
CAGPGIYNQGGKLIF

SEQ ID NO: 355 - protein, 18 aa, Homo sapiens
CAMSSSNAGGTSYGKLTF

SEQ ID NO: 356 - protein, 15 aa, Homo sapiens
CAASGLVEGNTPLVF

SEQ ID NO: 357 - protein, 14 aa, Homo sapiens
CATDGPYGNNRLAF

SEQ ID NO: 358 - protein, 14 aa, Homo sapiens
CATDGPYGNNRLAF

SEQ ID NO: 359 - protein, 14 aa, Homo sapiens
CATDGRHGNNRLAF

SEQ ID NO: 360 - protein, 14 aa, Homo sapiens
CAGERGSTLGRLYF

SEQ ID NO: 361 - protein, 14 aa, Homo sapiens
CAGERGSTLGRLYF

SEQ ID NO: 362 - protein, 14 aa, Homo sapiens
CAGERGSTLGRLYF

SEQ ID NO: 363 - protein, 14 aa, Homo sapiens
CAAPRGAAGNKLTF

SEQ ID NO: 364 - protein, 14 aa, Homo sapiens
CAGERGSTLGRLYF

SEQ ID NO: 365 - protein, 12 aa, Homo sapiens
CAALQGAQKLVF

SEQ ID NO: 366 - protein, 14 aa, Homo sapiens
CLVVPFGGYNKLIF

SEQ ID NO: 367 - protein, 14 aa, Homo sapiens
CAGERGSTLGRLYF

SEQ ID NO: 368 - protein, 13 aa, Homo sapiens
CAPDRPDTDKLIF

SEQ ID NO: 369 - protein, 15 aa, Homo sapiens
CAGPGTGAGSYQLTF

SEQ ID NO: 370 - protein, 15 aa, Homo sapiens
CAGPYSGAGSYQLTF

SEQ ID NO: 371 - protein, 14 aa, Homo sapiens
CLVVPFGGYNKLIF

SEQ ID NO: 372 - protein, 15 aa, Homo sapiens
CAVNVGNTGFQKLVF

SEQ ID NO: 373 - protein, 10 aa, Homo sapiens
CAASEFQFYF

SEQ ID NO: 374 - protein, 13 aa, Homo sapiens
CAMREGVDYQLIW

SEQ ID NO: 375 - protein, 12 aa, Homo sapiens
CAVKANFNKFYF

SEQ ID NO: 376 - protein, 13 aa, Homo sapiens
CAAEPFSSYKLIF

SEQ ID NO: 377 - protein, 15 aa, Homo sapiens
CAVESLIQGAQKLVF

SEQ ID NO: 378 - protein, 16 aa, Homo sapiens
CIVRVAGGTSYGKLTF

SEQ ID NO: 379 - protein, 15 aa, Homo sapiens
CAMRVNSGGYQKVTF

SEQ ID NO: 380 - protein, 13 aa, Homo sapiens
CVLSGAGSYQLTF

SEQ ID NO: 381 - protein, 15 aa, Homo sapiens
CALDEGNTGFQKLVF

SEQ ID NO: 382 - protein, 10 aa, Homo sapiens
RNTGFQKLVF

SEQ ID NO: 383 - protein, 16 aa, Homo sapiens
CAAPGVGSNSGYALNF

SEQ ID NO: 384 - protein, 14 aa, Homo sapiens
CAGEDQTGANNLFF

SEQ ID NO: 385 - protein, 14 aa, Homo sapiens
CAVKVGTGFQKLVF

SEQ ID NO: 386 - protein, 7 aa, Homo sapiens
CAVSMRF

SEQ ID NO: 387 - protein, 17 aa, Homo sapiens
CAVNPTPSVGSNYKLTF

SEQ ID NO: 388 - protein, 14 aa, Homo sapiens
CAVAAENYGQNFVF

SEQ ID NO: 389 - protein, 14 aa, Homo sapiens
CAFISSGSARQLTF

SEQ ID NO: 390 - protein, 15 aa, Homo sapiens
CAMREDLRSNDKVIF

SEQ ID NO: 391 - protein, 13 aa, Homo sapiens
CAAGGGSQGNLIF

SEQ ID NO: 392 - protein, 13 aa, Homo sapiens
CAMRELNDYKLSF

SEQ ID NO: 393 - protein, 9 aa, Homo sapiens
CATDGLPRF

SEQ ID NO: 394 - protein, 16 aa, Homo sapiens
CAVNRPSGGSNYKLTF

SEQ ID NO: 395 - protein, 14 aa, Homo sapiens
CATTGNSGYSTLTF

SEQ ID NO: 396 - protein, 14 aa, Homo sapiens
CARVGDSGYSTLTF

SEQ ID NO: 397 - protein, 14 aa, Homo sapiens
CATEGDSGYSTLTF

SEQ ID NO: 398 - protein, 14 aa, Homo sapiens
CATEGDSGYSTLTF

SEQ ID NO: 399 - protein, 14 aa, Homo sapiens
CATEGDSGYSTLTF

SEQ ID NO: 400 - protein, 14 aa, Homo sapiens
CATSGDSGYSTLTF

SEQ ID NO: 401 - protein, 14 aa, Homo sapiens
CATVGNSGYSTLTF

SEQ ID NO: 402 - protein, 14 aa, Homo sapiens
CATVGNSGYSTLTF

SEQ ID NO: 403 - protein, 14 aa, Homo sapiens
CATVGDSGYSTLTF

SEQ ID NO: 404 - protein, 14 aa, Homo sapiens
CATVGNSGYSTLTF

SEQ ID NO: 405 - protein, 14 aa, Homo sapiens
CATVGNSGYSTLTF

SEQ ID NO: 406 - protein, 14 aa, Homo sapiens
CATEGNSGYSTLTF

SEQ ID NO: 407 - protein, 14 aa, Homo sapiens
CATEGDSGYSTLTF

SEQ ID NO: 408 - protein, 14 aa, Homo sapiens
CATEGNSGYSTLTF

SEQ ID NO: 409 - protein, 14 aa, Homo sapiens
CATEGNSGYSTLTF

SEQ ID NO: 410 - protein, 14 aa, Homo sapiens
CATEGDSGYSTLTF

SEQ ID NO: 411 - protein, 14 aa, Homo sapiens
CATVGDSGYSTLTF

SEQ ID NO: 412 - protein, 13 aa, Homo sapiens
CASRTGGVNEQYF

SEQ ID NO: 413 - protein, 16 aa, Homo sapiens
CASSAGQGLAGDEQFF

SEQ ID NO: 414 - protein, 18 aa, Homo sapiens
CASSQEAASGGLINEQFF

SEQ ID NO: 415 - protein, 15 aa, Homo sapiens
CASSYSGGPLYEQYF

SEQ ID NO: 416 - protein, 15 aa, Homo sapiens
CASSYAGGPQYGYTF

SEQ ID NO: 417 - protein, 18 aa, Homo sapiens
CSARDGSPIAGGLNEQFF

SEQ ID NO: 418 - protein, 15 aa, Homo sapiens
CASSYSGGPLYEQYF

SEQ ID NO: 419 - protein, 16 aa, Homo sapiens
CASSVGEGLAGDTQYF

SEQ ID NO: 420 - protein, 15 aa, Homo sapiens
CASRYSGGPLYEQFF

SEQ ID NO: 421 - protein, 18 aa, Homo sapiens
CSARDGSPIAGGLNEQFF

SEQ ID NO: 422 - protein, 15 aa, Homo sapiens
CASSQEAGRQNTQYF

SEQ ID NO: 423 - protein, 13 aa, Homo sapiens
CATRTGAVNEQFF

SEQ ID NO: 424 - protein, 15 aa, Homo sapiens
CASSPAGRPGKPLHF

SEQ ID NO: 425 - protein, 13 aa, Homo sapiens
CASSVAPFYEQYF

SEQ ID NO: 426 - protein, 13 aa, Homo sapiens
CAWSPQGNSPLHF

SEQ ID NO: 427 - protein, 15 aa, Homo sapiens
CASSESGSPTGELFF

SEQ ID NO: 428 - protein, 13 aa, Homo sapiens
CASSVAPWYEQYF

SEQ ID NO: 429 - protein, 13 aa, Homo sapiens
CASSVSSWYEQFF

SEQ ID NO: 430 - protein, 14 aa, Homo sapiens
CASSLWTSNSPLHF

SEQ ID NO: 431 - protein, 15 aa, Homo sapiens
CAIRRGGSSYNEQFF

SEQ ID NO: 432 - protein, 16 aa, Homo sapiens
CASSADQGDGTDTQYF

SEQ ID NO: 433 - protein, 15 aa, Homo sapiens
CASSLNTGMNTEAFF

SEQ ID NO: 434 - protein, 15 aa, Homo sapiens
CASSRPEGIYNEQFF

SEQ ID NO: 435 - protein, 14 aa, Homo sapiens
CASSPGLADYEQYF

SEQ ID NO: 436 - protein, 15 aa, Homo sapiens
CAWRLEQGLNYEQYF

SEQ ID NO: 437 - protein, 16 aa, Homo sapiens
CASSLFPGTGIHEQYF

SEQ ID NO: 438 - protein, 17 aa, Homo sapiens
CASSPLGRSSSYNEQFF

SEQ ID NO: 439 - protein, 17 aa, Homo sapiens
CASSALGQSSSYNEQFF

SEQ ID NO: 440 - protein, 17 aa, Homo sapiens
CASSDLGRGSAVNEQFF

SEQ ID NO: 441 - protein, 15 aa, Homo sapiens
CASSPLDRGTYEQYF

SEQ ID NO: 442 - protein, 15 aa, Homo sapiens
CASSPLERGTYEQYF

SEQ ID NO: 443 - protein, 15 aa, Homo sapiens
CASSLLSSGDYEQYF

SEQ ID NO: 444 - protein, 16 aa, Homo sapiens
CASSKGASGMRTEQYF

SEQ ID NO: 445 - protein, 16 aa, Homo sapiens
CATSDTTSTRPTEQYV

SEQ ID NO: 446 - protein, 15 aa, Homo sapiens
CASSATSGSYNEQFF

SEQ ID NO: 447 - protein, 18 aa, Homo sapiens
CSVGEGTSGYESYNEQFF

SEQ ID NO: 448 - protein, 15 aa, Homo sapiens
CASSSLDRGDYEQYF

SEQ ID NO: 449 - protein, 15 aa, Homo sapiens
CASQNRREGRSEQFF

SEQ ID NO: 450 - protein, 14 aa, Homo sapiens
CASIKSSGYNEQFF

SEQ ID NO: 451 - protein, 14 aa, Homo sapiens
CASILSSGYNEQFF

SEQ ID NO: 452 - protein, 18 aa, Homo sapiens
CSVGEGTSGYESYNEQFF

SEQ ID NO: 453 - protein, 14 aa, Homo sapiens
CACQWQGLGGELFF

SEQ ID NO: 454 - protein, 16 aa, Homo sapiens
CASSPGQRANTGELFF

SEQ ID NO: 455 - protein, 12 aa, Homo sapiens
CASSYENEKLFF

SEQ ID NO: 456 - protein, 11 aa, Homo sapiens
CASSWGNEQFF

SEQ ID NO: 457 - protein, 16 aa, Homo sapiens
CASSFIGGTGLNEQFF

SEQ ID NO: 458 - protein, 17 aa, Homo sapiens
CSARDRFWGTNNEKLFF

SEQ ID NO: 459 - protein, 17 aa, Homo sapiens
CAWSSAPDRGHRQPQHF

SEQ ID NO: 460 - protein, 17 aa, Homo sapiens
CATSRDRGTGPPYEQYF

SEQ ID NO: 461 - protein, 13 aa, Homo sapiens
CASSEWREETQYF

SEQ ID NO: 462 - protein, 14 aa, Homo sapiens
CAWSGTDSSYEQYF

SEQ ID NO: 463 - protein, 16 aa, Homo sapiens
CASSPEQGAAGDEQFF

SEQ ID NO: 464 - protein, 15 aa, Homo sapiens
CASSPSWAANSPLHF

SEQ ID NO: 465 - protein, 13 aa, Homo sapiens
CASGTLSYNEQFF

SEQ ID NO: 466 - protein, 15 aa, Homo sapiens
CASSLVGQGNTEAFF

SEQ ID NO: 467 - protein, 16 aa, Homo sapiens
CASSLDEGTVTYEQYF

SEQ ID NO: 468 - protein, 13 aa, Homo sapiens
CASSVGGEGLAFF

SEQ ID NO: 469 - protein, 14 aa, Homo sapiens
CASSLEGDYNEQFF

SEQ ID NO: 470 - protein, 14 aa, Homo sapiens
CASSLEADNEKLFF

SEQ ID NO: 471 - protein, 14 aa, Homo sapiens
CASSVGDSGQAQYF

SEQ ID NO: 472 - protein, 15 aa, Homo sapiens
CASSWWDGGTGELFF

SEQ ID NO: 473 - protein, 13 aa, Homo sapiens
CATRDDLLAEAFF

SEQ ID NO: 474 - protein, 14 aa, Homo sapiens
CASSFGTNTGELFF

SEQ ID NO: 475 - protein, 13 aa, Homo sapiens
CASSFGQYNEQFF

SEQ ID NO: 476 - protein, 14 aa, Homo sapiens
CASSYGGGYYGYTF

SEQ ID NO: 477 - protein, 15 aa, Homo sapiens
CASSYQGTGAYGYTF

SEQ ID NO: 478 - protein, 14 aa, Homo sapiens
CASSYQGGSYGYTF

SEQ ID NO: 479 - protein, 14 aa, Homo sapiens
CASSRQGGSYGYTF

SEQ ID NO: 480 - protein, 14 aa, Homo sapiens
CASSPQGGNYGYTF

SEQ ID NO: 481 - protein, 14 aa, Homo sapiens
CASSPQGGNYGYTF

SEQ ID NO: 482 - protein, 13 aa, Homo sapiens
CASSFQGGNEQFF

SEQ ID NO: 483 - protein, 14 aa, Homo sapiens
CASSTQGGYQPQHF

SEQ ID NO: 484 - protein, 14 aa, Homo sapiens
CASSRQGGIDGYTF

SEQ ID NO: 485 - protein, 13 aa, Homo sapiens
CASSKQGGNEQFF

SEQ ID NO: 486 - protein, 13 aa, Homo sapiens
CASSPQGGNEQFF

SEQ ID NO: 487 - protein, 14 aa, Homo sapiens
CASNRQGGNYGYTF

SEQ ID NO: 488 - protein, 14 aa, Homo sapiens
CASSRQGGNYGYTF

SEQ ID NO: 489 - protein, 15 aa, Homo sapiens
CASSQQGGDHYGYTF

SEQ ID NO: 490 - protein, 14 aa, Homo sapiens
CASSPQGGSRGYTF

SEQ ID NO: 491 - protein, 14 aa, Homo sapiens
CASRLQGGFNGYTF

SEQ ID NO: 492 - protein, 14 aa, Homo sapiens
CASSVQGGAHEQYF

SEQ ID NO: 493 - DNA, 819 bp, Homo sapiens
atggagaccctgctgggcctgctgatcctgtggctgcagctgcagtgggtgagcagcaagcaggaggtgacccagatccccgccgccctgagcgtgcccgagggcgagaacctggtgctgaactgcagcttcaccgacagcgccatctacaacctgcagtggttccgccaggaccccggcaagggcctgaccagcctgctgctgatccagagcagccagcgcgagcagaccagcggccgcctgaacgccagcctggacaagagcagcggccgcagcaccctgtacatcgccgccagccagcccggcgacagcgccacctacctgtgcgccgtgtacagcggcgccggcagctaccagctgaccttcggcaagggcaccaagctgagcgtgatccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 494 - DNA, 807 bp, Homo sapiens
atgtggggcgtgttcctgctgtacgtgagcatgaagatgggcggcaccaccggccagaacatcgaccagcccaccgagatgaccgccaccgagggcgccatcgtgcagatcaactgcacctaccagaccagcggcttcaacggcctgttctggtaccagcagcacgccggcgaggcccccaccttcctgagctacaacgtgctggacggcctggaggagaagggccgcttcagcagcttcctgagccgcagcaagggctacagctacctgctgctgaaggagctgcagatgaaggacagcgccagctacctgtgcgccgtgggcggcaacaccggcggcttcaagaccatcttcggcgccggcacccgcctgttcgtgaaggccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 495 - DNA, 831 bp, Homo sapiens
atgctgaccgccagcctgctgcgcgccgtgatcgccagcatctgcgtggtgagcagcatggcccagaaggtgacccaggcccagaccgagatcagcgtggtggagaaggaggacgtgaccctggactgcgtgtacgagacccgcgacaccacctactacctgttctggtacaagcagccccccagcggcgagctggtgttcctgatccgccgcaacagcttcgacgagcagaacgagatcagcggccgctacagctggaacttccagaagagcaccagcagcttcaacttcaccatcaccgccagccaggtggtggacagcgccgtgtacttctgcgccctgagcgaggcccgcggcagccagggcaacctgatcttcggcaagggcaccaagctgagcgtgaagcccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 496 - DNA, 807 bp, Homo sapiens
atgaagctggtgaccagcatcaccgtgctgctgagcctgggcatcatgggcgacgccaagaccacccagcccaacagcatggagagcaacgaggaggagcccgtgcacctgccctgcaaccacagcaccatcagcggcaccgactacatccactggtaccgccagctgcccagccagggccccgagtacgtgatccacggcctgaccagcaacgtgaacaaccgcatggccagcctggccatcgccgaggaccgcaagagcagcaccctgatcctgcaccgcgccaccctgcgcgacgccgccgtgtactactgcatcctgcgcgacgtgaccggcggcttcaagaccatcttcggcgccggcacccgcctgttcgtgaaggccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 497 - DNA, 813 bp, Homo sapiens
atgctgctggagcacctgctgatcatcctgtggatgcagctgacctgggtgagcggccagcagctgaaccagagcccccagagcatgttcatccaggagggcgaggacgtgagcatgaactgcaccagcagcagcatcttcaacacctggctgtggtacaagcaggaccccggcgagggccccgtgctgctgatcgccctgtacaaggccggcgagctgaccagcaacggccgcctgaccgcccagttcggcatcacccgcaaggacagcttcctgaacatcagcgccagcatccccagcgacgtgggcatctacttctgcgccggccgcggcagctacaacttcaacaagttctacttcggcagcggcaccaagctgaacgtgaagcccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 498 - DNA, 795 bp, Homo sapiens
atgtggggcgccttcctgctgtacgtgagcatgaagatgggcggcaccgccggccagagcctggagcagcccagcgaggtgaccgccgtggagggcgccatcgtgcagatcaactgcacctaccagaccagcggcttctacggcctgagctggtaccagcagcacgacggcggcgcccccaccttcctgagctacaacgccctggacggcctggaggagaccggccgcttcagcagcttcctgagccgcagcgacagctacggctacctgctgctgcaggagctgcagatgaaggacagcgccagctacttctgcgccagcagcgagggcaagctgatcttcggccagggcaccgagctgagcgtgaagcccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 499 - DNA, 810 bp, Homo sapiens
atgaagcccaccctgatcagcgtgctggtgatcatcttcatcctgcgcggcacccgcgcccagcgcgtgacccagcccgagaagctgctgagcgtgttcaagggcgcccccgtggagctgaagtgcaactacagctacagcggcagccccgagctgttctggtacgtgcagtacagccgccagcgcctgcagctgctgctgcgccacatcagccgcgagagcatcaagggcttcaccgccgacctgaacaagggcgagaccagcttccacctgaagaagcccttcgcccaggaggaggacagcgccatgtactactgcgccctgcgctggcagaccggcgccaacaacctgttcttcggcaccggcacccgcctgaccgtgatcccctacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 500 - DNA, 807 bp, Homo sapiens
atgtggggcgtgttcctgctgtacgtgagcatgaagatgggcggcaccaccggccagaacatcgaccagcccaccgagatgaccgccaccgagggcgccatcgtgcagatcaactgcacctaccagaccagcggcttcaacggcctgttctggtaccagcagcacgccggcgaggcccccaccttcctgagctacaacgtgctggacggcctggaggagaagggccgcttcagcagcttcctgagccgcagcaagggctacagctacctgctgctgaaggagctgcagatgaaggacagcgccagctacctgtgcgccgtgaacggcggcaccggcggcttcaagaccatcttcggcgccggcacccgcctgttcgtgaaggccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 501 - DNA, 825 bp, Homo sapiens
atggagaagaaccccctggccgcccccctgctgatcctgtggttccacctggactgcgtgagcagcatcctgaacgtggagcagagcccccagagcctgcacgtgcaggagggcgacagcaccaacttcacctgcagcttccccagcagcaacttctacgccctgcactggtaccgctgggagaccgccaagagccccgaggccctgttcgtgatgaccctgaacggcgacgagaagaagaagggccgcatcagcgccaccctgaacaccaaggagggctacagctacctgtacatcaagggcagccagcccgaggacagcgccacctacctgtgcgccagcccccgcaccggcttccagaagctggtgttcggcaccggcacccgcctgctggtgagccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 502 - DNA, 795 bp, Homo sapiens
atgtggggcgccttcctgctgtacgtgagcatgaagatgggcggcaccgccggccagagcctggagcagcccagcgaggtgaccgccgtggagggcgccatcgtgcagatcaactgcacctaccagaccagcggcttctacggcctgagctggtaccagcagcacgacggcggcgcccccaccttcctgagctacaacgccctggacggcctggaggagaccggccgcttcagcagcttcctgagccgcagcgacagctacggctacctgctgctgcaggagctgcagatgaaggacagcgccagctacttctgcgccagcaccgagggcaagctgatcttcggccagggcaccgagctgagcgtgaagcccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 503 - DNA, 831 bp, Homo sapiens
atgacccgcgtgagcctgctgtgggccgtggtggtgagcacctgcctggagagcggcatggcccagaccgtgacccagagccagcccgagatgagcgtgcaggaggccgagaccgtgaccctgagctgcacctacgacaccagcgagaacaactactacctgttctggtacaagcagccccccagccgccagatgatcctggtgatccgccaggaggcctacaagcagcagaacgccaccgagaaccgcttcagcgtgaacttccagaaggccgccaagagcttcagcctgaagatcagcgacagccagctgggcgacaccgccatgtacttctgcgccttcatgaccgtgtacaaccagggcggcaagctgatcttcggccagggcaccgagctgagcgtgaagcccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 504 - DNA, 819 bp, Homo sapiens
atggagaccctgctgggcctgctgatcctgtggctgcagctgcagtgggtgagcagcaagcaggaggtgacccagatccccgccgccctgagcgtgcccgagggcgagaacctggtgctgaactgcagcttcaccgacagcgccatctacaacctgcagtggttccgccaggaccccggcaagggcctgaccagcctgctgctgatccagagcagccagcgcgagcagaccagcggccgcctgaacgccagcctggacaagagcagcggccgcagcaccctgtacatcgccgccagccagcccggcgacagcgccacctacctgtgcgccccctacagcggcgccggcgcctaccagctgaccttcggcaagggcaccaagctgagcgtgatccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 505 - DNA, 822 bp, Homo sapiens
atggagaccctgctgggcctgctgatcctgtggctgcagctgcagtgggtgagcagcaagcaggaggtgacccagatccccgccgccctgagcgtgcccgagggcgagaacctggtgctgaactgcagcttcaccgacagcgccatctacaacctgcagtggttccgccaggaccccggcaagggcctgaccagcctgctgctgatccagagcagccagcgcgagcagaccagcggccgcctgaacgccagcctggacaagagcagcggccgcagcaccctgtacatcgccgccagccagcccggcgacagcgccacctacctgtgcgccgtgtgggccggcggcaccagctacggcaagctgaccttcggccagggcaccatcctgaccgtgcaccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 506 - DNA, 804 bp, Homo sapiens
atgaagcgcatcctgggcgccctgctgggcctgctgagcgcccaggtgtgctgcgtgcgcggcatccaggtggagcagagcccccccgacctgatcctgcaggagggcgccaacagcaccctgcgctgcaacttcagcgacagcgtgaacaacctgcagtggttccaccagaacccctggggccagctgatcaacctgttctacatccccagcggcaccaagcagaacggccgcctgagcgccaccaccgtggccaccgagcgctacagcctgctgtacatcagcagcagccagaccaccgacagcggcgtgtacttctgcgccgtggtgatcaacaacgacatgcgcttcggcgccggcacccgcctgaccgtgaagcccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 507 - DNA, 822 bp, Homo sapiens
atggccagcgcccccatcagcatgctggccatgctgttcaccctgagcggcctgcgcgcccagagcgtggcccagcccgaggaccaggtgaacgtggccgagggcaaccccctgaccgtgaagtgcacctacagcgtgagcggcaacccctacctgttctggtacgtgcagtaccccaaccgcggcctgcagttcctgctgaagtacatcaccggcgacaacctggtgaagggcagctacggcttcgaggccgagttcaacaagagccagaccagcttccacctgaagaagcccagcgccctggtgagcgacagcgccctgtacttctgcgccgtgcgcgaggccagcggcgccaacaacctgttcttcggcaccggcacccgcctgaccgtgatcccctacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 508 - DNA, 828 bp, Homo sapiens
atgctgctgctgctggtgcccgtgctggaggtgatcttcaccctgggcggcacccgcgcccagagcgtgacccagctggacagccacgtgagcgtgagcgagggcacccccgtgctgctgcgctgcaactacagcagcagctacagccccagcctgttctggtacgtgcagcaccccaacaagggcctgcagctgctgctgaagtacaccagcgccgccaccctggtgaagggcatcaacggcttcgaggccgagttcaagaagagcgagaccagcttccacctgaccaagcccagcgcccacatgagcgacgccgccgagtacttctgcgtggtgagctacctgggcgacaccggccgccgcgccctgaccttcggcagcggcacccgcctgcaggtgcagcccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 509 - DNA, 804 bp, Homo sapiens
atgaagcgcatcctgggcgccctgctgggcctgctgagcgcccaggtgtgctgcgtgcgcggcatccaggtggagcagagcccccccgacctgatcctgcaggagggcgccaacagcaccctgcgctgcaacttcagcgacagcgtgaacaacctgcagtggttccaccagaacccctggggccagctgatcaacctgttctacatccccagcggcaccaagcagaacggccgcctgagcgccaccaccgtggccaccgagcgctacagcctgctgtacatcagcagcagccagaccaccgacagcggcgtgtacttctgcgccgtggtgggcaacaacgacatgcgcttcggcgccggcacccgcctgaccgtgaagcccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 510 - DNA, 804 bp, Homo sapiens
atgaagcgcatcctgggcgccctgctgggcctgctgagcgcccaggtgtgctgcgtgcgcggcatccaggtggagcagagcccccccgacctgatcctgcaggagggcgccaacagcaccctgcgctgcaacttcagcgacagcgtgaacaacctgcagtggttccaccagaacccctggggccagctgatcaacctgttctacatccccagcggcaccaagcagaacggccgcctgagcgccaccaccgtggccaccgagcgctacagcctgctgtacatcagcagcagccagaccaccgacagcggcgtgtacttctgcgccgtgctgaacaacaacgacatgcgcttcggcgccggcacccgcctgaccgtgaagcccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 511 - DNA, 819 bp, Homo sapiens
atggccggcatccgcgccctgttcatgtacctgtggctgcagctggactgggtgagccgcggcgagagcgtgggcctgcacctgcccaccctgagcgtgcaggagggcgacaacagcatcatcaactgcgcctacagcaacagcgccagcgactacttcatctggtacaagcaggagagcggcaagggcccccagttcatcatcgacatccgcagcaacatggacaagcgccagggccagcgcgtgaccgtgctgctgaacaagaccgtgaagcacctgagcctgcagatcgccgccacccagcccggcgacagcgccgtgtacttctgcgccgagacccccggcggctaccagaaggtgaccttcggcaccggcaccaagctgcaggtgatccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 512 - DNA, 834 bp, Homo sapiens
atggccatgctgctgggcgccagcgtgctgatcctgtggctgcagcccgactgggtgaacagccagcagaagaacgacgaccagcaggtgaagcagaacagccccagcctgagcgtgcaggagggccgcatcagcatcctgaactgcgactacaccaacagcatgttcgactacttcctgtggtacaagaagtaccccgccgagggccccaccttcctgatcagcatcagcagcatcaaggacaagaacgaggacggccgcttcaccgtgttcctgaacaagagcgccaagcacctgagcctgcacatcgtgcccagccagcccggcgacagcgccgtgtacttctgcgccgccagcgccggcggccagaacttcgtgttcggccccggcacccgcctgagcgtgctgccctacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 513 - DNA, 801 bp, Homo sapiens
atgtggggcgtgttcctgctgtacgtgagcatgaagatgggcggcaccaccggccagaacatcgaccagcccaccgagatgaccgccaccgagggcgccatcgtgcagatcaactgcacctaccagaccagcggcttcaacggcctgttctggtaccagcagcacgccggcgaggcccccaccttcctgagctacaacgtgctggacggcctggaggagaagggccgcttcagcagcttcctgagccgcagcaagggctacagctacctgctgctgaaggagctgcagatgaaggacagcgccagctacctgtgcgccgtgaaggacagcaactaccagctgatctggggcgccggcaccaagctgatcatcaagcccgacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 514 - DNA, 807 bp, Homo sapiens
atgtggggcgccttcctgctgtacgtgagcatgaagatgggcggcaccgccggccagagcctggagcagcccagcgaggtgaccgccgtggagggcgccatcgtgcagatcaactgcacctaccagaccagcggcttctacggcctgagctggtaccagcagcacgacggcggcgcccccaccttcctgagctacaacgccctggacggcctggaggagaccggccgcttcagcagcttcctgagccgcagcgacagctacggctacctgctgctgcaggagctgcagatgaaggacagcgccagctacttctgcgccgtgccccgccgcaacaacaacgcccgcctgatgttcggcgacggcacccagctggtggtgaagcccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 515 - DNA, 828 bp, Homo sapiens
atggagaccctgctgggcctgctgatcctgtggctgcagctgcagtgggtgagcagcaagcaggaggtgacccagatccccgccgccctgagcgtgcccgagggcgagaacctggtgctgaactgcagcttcaccgacagcgccatctacaacctgcagtggttccgccaggaccccggcaagggcctgaccagcctgctgctgatccagagcagccagcgcgagcagaccagcggccgcctgaacgccagcctggacaagagcagcggccgcagcaccctgtacatcgccgccagccagcccggcgacagcgccacctacctgtgcgccgtgggcggcgacgacagcggcgccggcagctaccagctgaccttcggcaagggcaccaagctgagcgtgatccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 516 - DNA, 816 bp, Homo sapiens
atgctgctgatcaccagcatgctggtgctgtggatgcagctgagccaggtgaacggccagcaggtgatgcagatcccccagtaccagcacgtgcaggagggcgaggacttcaccacctactgcaacagcagcaccaccctgagcaacatccagtggtacaagcagcgccccggcggccaccccgtgttcctgatccagctggtgaagagcggcgaggtgaagaagcagaagcgcctgaccttccagttcggcgaggccaagaagaacagcagcctgcacatcaccgccacccagaccaccgacgtgggcacctacttctgcgccggccccggcatctacaaccagggcggcaagctgatcttcggccagggcaccgagctgagcgtgaagcccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 517 - DNA, 840 bp, Homo sapiens
atgagcctgagcagcctgctgaaggtggtgaccgccagcctgtggctgggccccggcatcgcccagaagatcacccagacccagcccggcatgttcgtgcaggagaaggaggccgtgaccctggactgcacctacgacaccagcgaccccagctacggcctgttctggtacaagcagcccagcagcggcgagatgatcttcctgatctaccagggcagctacgaccagcagaacgccaccgagggccgctacagcctgaacttccagaaggcccgcaagagcgccaacctggtgatcagcgccagccagctgggcgacagcgccatgtacttctgcgccatgagcagcagcaacgccggcggcaccagctacggcaagctgaccttcggccagggcaccatcctgaccgtgcaccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 518 - DNA, 843 bp, Homo sapiens
atggccatgctgctgggcgccagcgtgctgatcctgtggctgcagcccgactgggtgaacagccagcagaagaacgacgaccagcaggtgaagcagaacagccccagcctgagcgtgcaggagggccgcatcagcatcctgaactgcgactacaccaacagcatgttcgactacttcctgtggtacaagaagtaccccgccgagggccccaccttcctgatcagcatcagcagcatcaaggacaagaacgaggacggccgcttcaccgtgttcctgaacaagagcgccaagcacctgagcctgcacatcgtgcccagccagcccggcgacagcgccgtgtacttctgcgccgccagcggcctggtggagggcaacacccccctggtgttcggcaagggcacccgcctgagcgtgatcgccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 519 - DNA, 819 bp, Homo sapiens
atggagaccctgctgggcgtgagcctggtgatcctgtggctgcagctggcccgcgtgaacagccagcagggcgaggaggacccccaggccctgagcatccaggagggcgagaacgccaccatgaactgcagctacaagaccagcatcaacaacctgcagtggtaccgccagaacagcggccgcggcctggtgcacctgatcctgatccgcagcaacgagcgcgagaagcacagcggccgcctgcgcgtgaccctggacaccagcaagaagagcagcagcctgctgatcaccgccagccgcgccgccgacaccgccagctacttctgcgccaccgacggcccctacggcaacaaccgcctggccttcggcaagggcaaccaggtggtggtgatccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 520 - DNA, 819 bp, Homo sapiens; identical to SEQ ID NO: 519

SEQ ID NO: 521 - DNA, 819 bp, Homo sapiens
atggagaccctgctgggcgtgagcctggtgatcctgtggctgcagctggcccgcgtgaacagccagcagggcgaggaggacccccaggccctgagcatccaggagggcgagaacgccaccatgaactgcagctacaagaccagcatcaacaacctgcagtggtaccgccagaacagcggccgcggcctggtgcacctgatcctgatccgcagcaacgagcgcgagaagcacagcggccgcctgcgcgtgaccctggacaccagcaagaagagcagcagcctgctgatcaccgccagccgcgccgccgacaccgccagctacttctgcgccaccgacggccgccacggcaacaaccgcctggccttcggcaagggcaaccaggtggtggtgatccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 522 - DNA, 813 bp, Homo sapiens
atgctgctgatcaccagcatgctggtgctgtggatgcagctgagccaggtgaacggccagcaggtgatgcagatcccccagtaccagcacgtgcaggagggcgaggacttcaccacctactgcaacagcagcaccaccctgagcaacatccagtggtacaagcagcgccccggcggccaccccgtgttcctgatccagctggtgaagagcggcgaggtgaagaagcagaagcgcctgaccttccagttcggcgaggccaagaagaacagcagcctgcacatcaccgccacccagaccaccgacgtgggcacctacttctgcgccggcgagcgcggcagcaccctgggccgcctgtacttcggccgcggcacccagctgaccgtgtggcccgacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 523 - DNA, 813 bp, Homo sapiens; identical to SEQ ID NO: 522

SEQ ID NO: 524 - DNA, 813 bp, Homo sapiens; identical to SEQ ID NO: 522

SEQ ID NO: 525 - DNA, 819 bp, Homo sapiens
atgaccagcatccgcgccgtgttcatcttcctgtggctgcagctggacctggtgaacggcgagaacgtggagcagcaccccagcaccctgagcgtgcaggagggcgacagcgccgtgatcaagtgcacctacagcgacagcgccagcaactacttcccctggtacaagcaggagctgggcaagcgcccccagctgatcatcgacatccgcagcaacgtgggcgagaagaaggaccagcgcatcgccgtgaccctgaacaagaccgccaagcacttcagcctgcacatcaccgagacccagcccgaggacagcgccgtgtacttctgcgccgccccccgcggcgccgccggcaacaagctgaccttcggcggcggcacccgcgtgctggtgaagcccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 526 - DNA, 813 bp, Homo sapiens; identical to SEQ ID NO: 522

SEQ ID NO: 527 - DNA, 813 bp, Homo sapiens
atggagaccctgctgggcgtgagcctggtgatcctgtggctgcagctggcccgcgtgaacagccagcagggcgaggaggacccccaggccctgagcatccaggagggcgagaacgccaccatgaactgcagctacaagaccagcatcaacaacctgcagtggtaccgccagaacagcggccgcggcctggtgcacctgatcctgatccgcagcaacgagcgcgagaagcacagcggccgcctgcgcgtgaccctggacaccagcaagaagagcagcagcctgctgatcaccgccagccgcgccgccgacaccgccagctacttctgcgccgccctgcagggcgcccagaagctggtgttcggccagggcacccgcctgaccatcaaccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 528 - DNA, 807 bp, Homo sapiens
atgcgccaggtggcccgcgtgatcgtgttcctgaccctgagcaccctgagcctggccaagaccacccagcccatcagcatggacagctacgagggccaggaggtgaacatcacctgcagccacaacaacatcgccaccaacgactacatcacctggtaccagcagttccccagccagggcccccgcttcatcatccagggctacaagaccaaggtgaccaacgaggtggccagcctgttcatccccgccgaccgcaagagcagcaccctgagcctgccccgcgtgagcctgagcgacaccgccgtgtactactgcctggtggtgcccttcggcggctacaacaagctgatcttcggcgccggcacccgcctggccgtgcacccctacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 529 - DNA, 813 bp, Homo sapiens; identical to SEQ ID NO: 522

SEQ ID NO: 530 - DNA, 816 bp, Homo sapiens
atggagaccctgctgggcgtgagcctggtgatcctgtggctgcagctggcccgcgtgaacagccagcagggcgaggaggacccccaggccctgagcatccaggagggcgagaacgccaccatgaactgcagctacaagaccagcatcaacaacctgcagtggtaccgccagaacagcggccgcggcctggtgcacctgatcctgatccgcagcaacgagcgcgagaagcacagcggccgcctgcgcgtgaccctggacaccagcaagaagagcagcagcctgctgatcaccgccagccgcgccgccgacaccgccagctacttctgcgcccccgaccgccccgacaccgacaagctgatcttcggcaccggcacccgcctgcaggtgttccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 531 - DNA, 816 bp, Homo sapiens
atgctgctgatcaccagcatgctggtgctgtggatgcagctgagccaggtgaacggccagcaggtgatgcagatcccccagtaccagcacgtgcaggagggcgaggacttcaccacctactgcaacagcagcaccaccctgagcaacatccagtggtacaagcagcgccccggcggccaccccgtgttcctgatccagctggtgaagagcggcgaggtgaagaagcagaagcgcctgaccttccagttcggcgaggccaagaagaacagcagcctgcacatcaccgccacccagaccaccgacgtgggcacctacttctgcgccggccccggcaccggcgccggcagctaccagctgaccttcggcaagggcaccaagctgagcgtgatccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 532 - DNA, 816 bp, Homo sapiens
atgctgctgatcaccagcatgctggtgctgtggatgcagctgagccaggtgaacggccagcaggtgatgcagatcccccagtaccagcacgtgcaggagggcgaggacttcaccacctactgcaacagcagcaccaccctgagcaacatccagtggtacaagcagcgccccggcggccaccccgtgttcctgatccagctggtgaagagcggcgaggtgaagaagcagaagcgcctgaccttccagttcggcgaggccaagaagaacagcagcctgcacatcaccgccacccagaccaccgacgtgggcacctacttctgcgccggcccctacagcggcgccggcagctaccagctgaccttcggcaagggcaccaagctgagcgtgatccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 533 - DNA, 807 bp, Homo sapiens; identical to SEQ ID NO: 528

SEQ ID NO: 534 - DNA, 825 bp, Homo sapiens
atgaagagcctgcgcgtgctgctggtgatcctgtggctgcagctgagctgggtgtggagccagcagaaggaggtggagcagaacagcggccccctgagcgtgcccgagggcgccatcgccagcctgaactgcacctacagcgaccgcggcagccagagcttcttctggtaccgccagtacagcggcaagagccccgagctgatcatgttcatctacagcaacggcgacaaggaggacggccgcttcaccgcccagctgaacaaggccagccagtacgtgagcctgctgatccgcgacagccagcccagcgacagcgccacctacctgtgcgccgtgaacgtgggcaacaccggcttccagaagctggtgttcggcaccggcacccgcctgctggtgagccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 535 - DNA, 807 bp, Homo sapiens
atgaccagcatccgcgccgtgttcatcttcctgtggctgcagctggacctggtgaacggcgagaacgtggagcagcaccccagcaccctgagcgtgcaggagggcgacagcgccgtgatcaagtgcacctacagcgacagcgccagcaactacttcccctggtacaagcaggagctgggcaagggcccccagctgatcatcgacatccgcagcaacgtgggcgagaagaaggaccagcgcatcgccgtgaccctgaacaagaccgccaagcacttcagcctgcacatcaccgagacccagcccgaggacagcgccgtgtacttctgcgccgccagcgagttccagttctacttcggcaccggcaccagcctgaccgtgatccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 536 - DNA, 825 bp, Homo sapiens
atgagcctgagcagcctgctgaaggtggtgaccgccagcctgtggctgggccccggcatcgcccagaagatcacccagacccagcccggcatgttcgtgcaggagaaggaggccgtgaccctggactgcacctacgacaccagcgaccccagctacggcctgttctggtacaagcagcccagcagcggcgagatgatcttcctgatctaccagggcagctacgaccagcagaacgccaccgagggccgctacagcctgaacttccagaaggcccgcaagagcgccaacctggtgatcagcgccagccagctgggcgacagcgccatgtacttctgcgccatgcgcgagggcgtggactaccagctgatctggggcgccggcaccaagctgatcatcaagcccgacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 537 - DNA, 816 bp, Homo sapiens
atgctgctgctgctgatccccgtgctgggcatgatcttcgccctgcgcgacgcccgcgcccagagcgtgagccagcacaaccaccacgtgatcctgagcgaggccgccagcctggagctgggctgcaactacagctacggcggcaccgtgaacctgttctggtacgtgcagtaccccggccagcacctgcagctgctgctgaagtacttcagcggcgaccccctggtgaagggcatcaagggcttcgaggccgagttcatcaagagcaagttcagcttcaacctgcgcaagcccagcgtgcagtggagcgacaccgccgagtacttctgcgccgtgaaggccaacttcaacaagttctacttcggcagcggcaccaagctgaacgtgaagcccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 538 - DNA, 819 bp, Homo sapiens
atgaagagcctgcgcgtgctgctggtgatcctgtggctgcagctgagctgggtgtggagccagcagaaggaggtggagcagaacagcggccccctgagcgtgcccgagggcgccatcgccagcctgaactgcacctacagcgaccgcggcagccagagcttcttctggtaccgccagtacagcggcaagagccccgagctgatcatgttcatctacagcaacggcgacaaggaggacggccgcttcaccgcccagctgaacaaggccagccagtacgtgagcctgctgatccgcgacagccagcccagcgacagcgccacctacctgtgcgccgccgagcccttcagcagctacaagctgatcttcggcagcggcacccgcctgctggtgcgccccgacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 539 - DNA, 825 bp, Homo sapiens
atgatgaagtgcccccaggccctgctggccatcttctggctgctgctgagctgggtgagcagcgaggacaaggtggtgcagagccccctgagcctggtggtgcacgagggcgacaccgtgaccctgaactgcagctacgaggtgaccaacttccgcagcctgctgtggtacaagcaggagaagaaggcccccaccttcctgttcatgctgaccagcagcggcatcgagaagaagagcggccgcctgagcagcatcctggacaagaaggagctgagcagcatcctgaacatcaccgccacccagaccggcgacagcgccatctacctgtgcgccgtggagagcctgatccagggcgcccagaagctggtgttcggccagggcacccgcctgaccatcaaccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 540 - DNA, 813 bp, Homo sapiens
atgcgcctggtggcccgcgtgaccgtgttcctgaccttcggcaccatcatcgacgccaagaccacccagccccccagcatggactgcgccgagggccgcgccgccaacctgccctgcaaccacagcaccatcagcggcaacgagtacgtgtactggtaccgccagatccacagccagggcccccagtacatcatccacggcctgaagaacaacgagaccaacgagatggccagcctgatcatcaccgaggaccgcaagagcagcaccctgatcctgccccacgccaccctgcgcgacaccgccgtgtactactgcatcgtgcgcgtggccggcggcaccagctacggcaagctgaccttcggccagggcaccatcctgaccgtgcaccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 541 - DNA, 831 bp, Homo sapiens
atgagcctgagcagcctgctgaaggtggtgaccgccagcctgtggctgggccccggcatcgcccagaagatcacccagacccagcccggcatgttcgtgcaggagaaggaggccgtgaccctggactgcacctacgacaccagcgaccagagctacggcctgttctggtacaagcagcccagcagcggcgagatgatcttcctgatctaccagggcagctacgacgagcagaacgccaccgagggccgctacagcctgaacttccagaaggcccgcaagagcgccaacctggtgatcagcgccagccagctgggcgacagcgccatgtacttctgcgccatgcgcgtgaacagcggcggctaccagaaggtgaccttcggcaccggcaccaagctgcaggtgatccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 542 - DNA, 816 bp, Homo sapiens
atgatcagcctgcgcgtgctgctggtgatcctgtggctgcagctgagctgggtgtggagccagcgcaaggaggtggagcaggaccccggccccttcaacgtgcccgagggcgccaccgtggccttcaactgcacctacagcaacagcgccagccagagcttcttctggtaccgccaggactgccgcaaggagcccaagctgctgatgagcgtgtacagcagcggcaacgaggacggccgcttcaccgcccagctgaaccgcgccagccagtacatcagcctgctgatccgcgacagcaagctgagcgacagcgccacctacctgtgcgtgctgagcggcgccggcagctaccagctgaccttcggcaagggcaccaagctgagcgtgatccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 543 - DNA, 825 bp, Homo sapiens
atggagagcttcctgggcggcgtgctgctgatcctgtggctgcaggtggactgggtgaagagccagaagatcgagcagaacagcgaggccctgaacatccaggagggcaagaccgccaccctgacctgcaactacaccaactacagccccgcctacctgcagtggtaccgccaggaccccggccgcggccccgtgttcctgctgctgatccgcgagaacgagaaggagaagcgcaaggagcgcctgaaggtgaccttcgacaccaccctgaagcagagcctgttccacatcaccgccagccagcccgccgacagcgccacctacctgtgcgccctggacgagggcaacaccggcttccagaagctggtgttcggcaccggcacccgcctgctggtgagccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 544 - DNA, 789 bp, Homo sapiens
atgtggggcgtgttcctgctgtacgtgagcatgaagatgggcggcaccaccggccagaacatcgaccagcccaccgagatgaccgccaccgagggcgccatcgtgcagatcaactgcacctaccagaccagcggcttcaacggcctgttctggtaccagcagcacgccggcgaggcccccaccttcctgagctacaacgtgctggacggcctggaggagaagggccgcttcagcagcttcctgagccgcagcaagggctacagctacctgctgctgaaggagctgcagatgaaggacagcgccagccgcaacaccggcttccagaagctggtgttcggcaccggcacccgcctgctggtgagccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 545 - DNA, 828 bp, Homo sapiens
atgctgctggagctgatccccctgctgggcatccacttcgtgctgcgcaccgcccgcgcccagagcgtgacccagcccgacatccacatcaccgtgagcgagggcgccagcctggagctgcgctgcaactacagctacggcgccaccccctacctgttctggtacgtgcagagccccggccagggcctgcagctgctgctgaagtacttcagcggcgacaccctggtgcagggcatcaagggcttcgaggccgagttcaagcgcagccagagcagcttcaacctgcgcaagcccagcgtgcactggagcgacgccgccgagtacttctgcgccgcccccggcgtgggcagcaacagcggctacgccctgaacttcggcaagggcaccagcctgctggtgaccccccacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 546 - DNA, 807 bp, Homo sapiens
atgtggggcgtgttcctgctgtacgtgagcatgaagatgggcggcaccaccggccagaacatcgaccagcccaccgagatgaccgccaccgagggcgccatcgtgcagatcaactgcacctaccagaccagcggcttcaacggcctgttctggtaccagcagcacgccggcgaggcccccaccttcctgagctacaacgtgctggacggcctggaggagaagggccgcttcagcagcttcctgagccgcagcaagggctacagctacctgctgctgaaggagctgcagatgaaggacagcgccagctacctgtgcgccggcgaggaccagaccggcgccaacaacctgttcttcggcaccggcacccgcctgaccgtgatcccctacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 547 - DNA, 822 bp, Homo sapiens
atgaagagcctgcgcgtgctgctggtgatcctgtggctgcagctgagctgggtgtggagccagcagaaggaggtggagcagaacagcggccccctgagcgtgcccgagggcgccatcgccagcctgaactgcacctacagcgaccgcggcagccagagcttcttctggtaccgccagtacagcggcaagagccccgagctgatcatgttcatctacagcaacggcgacaaggaggacggccgcttcaccgcccagctgaacaaggccagccagtacgtgagcctgctgatccgcgacagccagcccagcgacagcgccacctacctgtgcgccgtgaaggtgggcaccggcttccagaagctggtgttcggcaccggcacccgcctgctggtgagccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 548 - DNA, 801 bp, Homo sapiens
atgctgctgctgctgatccccgtgctgggcatgatcttcgccctgcgcgacgcccgcgcccagagcgtgagccagcacaaccaccacgtgatcctgagcgaggccgccagcctggagctgggctgcaactacagctacggcggcaccgtgaacctgttctggtacgtgcagtaccccggccagcacctgcagctgctgctgaagtacttcagcggcgaccccctggtgaagggcatcaagggcttcgaggccgagttcatcaagagcaagttcagcttcaacctgcgcaagcccagcgtgcagtggagcgacaccgccgagtacttctgcgccgtgagcatgcgcttcggcgccggcacccgcctgaccgtgaagcccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 549 - DNA, 831 bp, Homo sapiens
atgaagagcctgcgcgtgctgctggtgatcctgtggctgcagctgagctgggtgtggagccagcagaaggaggtggagcagaacagcggccccctgagcgtgcccgagggcgccatcgccagcctgaactgcacctacagcgaccgcggcagccagagcttcttctggtaccgccagtacagcggcaagagccccgagctgatcatgttcatctacagcaacggcgacaaggaggacggccgcttcaccgcccagctgaacaaggccagccagtacgtgagcctgctgatccgcgacagccagcccagcgacagcgccacctacctgtgcgccgtgaaccccacccccagcgtgggcagcaactacaagctgaccttcggcaagggcaccctgctgaccgtgaaccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 550 - DNA, 822 bp, Homo sapiens
atgatgaagtgcccccaggccctgctggccatcttctggctgctgctgagctgggtgagcagcgaggacaaggtggtgcagagccccctgagcctggtggtgcacgagggcgacaccgtgaccctgaactgcagctacgaggtgaccaacttccgcagcctgctgtggtacaagcaggagaagaaggcccccaccttcctgttcatgctgaccagcagcggcatcgagaagaagagcggccgcctgagcagcatcctggacaagaaggagctgttcagcatcctgaacatcaccgccacccagaccggcgacagcgccgtgtacctgtgcgccgtggccgccgagaactacggccagaacttcgtgttcggccccggcacccgcctgagcgtgctgccctacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 551 - DNA, 828 bp, Homo sapiens
atggagaagaaccccctggccgcccccctgctgatcctgtggttccacctggactgcgtgagcagcatcctgaacgtggagcagagcccccagagcctgcacgtgcaggagggcgacagcaccaacttcacctgcagcttccccagcagcaacttctacgccctgcactggtaccgctgggagaccgccaagagccccgaggccctgttcgtgatgaccctgaacggcgacgagaagaagaagggccgcatcagcgccaccctgaacaccaaggagggctacagctacctgtacatcaagggcagccagcccgaggacagcgccacctacctgtgcgccttcatcagcagcggcagcgcccgccagctgaccttcggcagcggcacccagctgaccgtgctgcccgacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 552 - DNA, 831 bp, Homo sapiens
atgagcctgagcagcctgctgaaggtggtgaccgccagcctgtggctgggccccggcatcgcccagaagatcacccagacccagcccggcatgttcgtgcaggagaaggaggccgtgaccctggactgcacctacgacaccagcgaccagagctacggcctgttctggtacaagcagcccagcagcggcgagatgatcttcctgatctaccagggcagctacgacgagcagaacgccaccgagggccgctacagcctgaacttccagaaggcccgcaagagcgccaacctggtgatcagcgccagccagctgggcgacagcgccatgtacttctgcgccatgcgcgaggacctgcgcagcaacgacaaggtgatcttcggccccggcaccagcctgagcgtgatccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 553 - DNA, 819 bp, Homo sapiens
atgctgctgctgctgatccccgtgctgggcatgatcttcgccctgcgcgacgcccgcgcccagagcgtgagccagcacaaccaccacgtgatcctgagcgaggccgccagcctggagctgggctgcaactacagctacggcggcaccgtgaacctgttctggtacgtgcagtaccccggccagcacctgcagctgctgctgaagtacttcagcggcgaccccctggtgaagggcatcaagggcttcgaggccgagttcatcaagagcaagttcagcttcaacctgcgcaagcccagcgtgcagtggagcgacaccgccgagtacttctgcgccgccggcggcggcagccagggcaacctgatcttcggcaagggcaccaagctgagcgtgaagcccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 554 - DNA, 825 bp, Homo sapiens
atgagcctgagcagcctgctgaaggtggtgaccgccagcctgtggctgggccccggcatcgcccagaagatcacccagacccagcccggcatgttcgtgcaggagaaggaggccgtgaccctggactgcacctacgacaccagcgaccccagctacggcctgttctggtacaagcagcccagcagcggcgagatgatcttcctgatctaccagggcagctacgaccagcagaacgccaccgagggccgctacagcctgaacttccagaaggcccgcaagagcgccaacctggtgatcagcgccagccagctgggcgacagcgccatgtacttctgcgccatgcgcgagctgaacgactacaagctgagcttcggcgccggcaccaccgtgaccgtgcgcgccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 555 - DNA, 804 bp, Homo sapiens
atggagaccctgctgggcgtgagcctggtgatcctgtggctgcagctggcccgcgtgaacagccagcagggcgaggaggacccccaggccctgagcatccaggagggcgagaacgccaccatgaactgcagctacaagaccagcatcaacaacctgcagtggtaccgccagaacagcggccgcggcctggtgcacctgatcctgatccgcagcaacgagcgcgagaagcacagcggccgcctgcgcgtgaccctggacaccagcaagaagagcagcagcctgctgatcaccgccagccgcgccgccgacaccgccagctacttctgcgccaccgacggcctgccccgcttcggcgccggcacccgcctgaccgtgaagcccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 556 - DNA, 828 bp, Homo sapiens
atgctgctgctgctgatccccgtgctgggcatgatcttcgccctgcgcgacgcccgcgcccagagcgtgagccagcacaaccaccacgtgatcctgagcgaggccgccagcctggagctgggctgcaactacagctacggcggcaccgtgaacctgttctggtacgtgcagtaccccggccagcacctgcagctgctgctgaagtacttcagcggcgaccccctggtgaagggcatcaagggcttcgaggccgagttcatcaagagcaagttcagcttcaacctgcgcaagcccagcgtgcagtggagcgacaccgccgagtacttctgcgccgtgaaccgccccagcggcggcagcaactacaagctgaccttcggcaagggcaccctgctgaccgtgaaccccaacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 557 - DNA, 819 bp, Homo sapiens
atggagaccctgctgggcgtgagcctggtgatcctgtggctgcagctggcccgcgtgaacagccagcagggcgaggaggacccccaggccctgagcatccaggagggcgagaacgccaccatgaactgcagctacaagaccagcatcaacaacctgcagtggtaccgccagaacagcggccgcggcctggtgcacctgatcctgatccgcagcaacgagcgcgagaagcacagcggccgcctgcgcgtgaccctggacaccagcaagaagagcagcagcctgctgatcaccgccagccgcgccgccgacaccgccagctacttctgcgccaccaccggcaacagcggctacagcaccctgaccttcggcaagggcaccatgctgctggtgagccccgacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 558 - DNA, 819 bp, Homo sapiens
atggagaccctgctgggcgtgagcctggtgatcctgtggctgcagctggcccgcgtgaacagccagcagggcgaggaggacccccaggccctgagcatccaggagggcgagaacgccaccatgaactgcagctacaagaccagcatcaacaacctgcagtggtaccgccagaacagcggccgcggcctggtgcacctgatcctgatccgcagcaacgagcgcgagaagcacagcggccgcctgcgcgtgaccctggacaccagcaagaagagcagcagcctgctgatcaccgccagccgcgccgccgacaccgccagctacttctgcgcccgcgtgggcgacagcggctacagcaccctgaccttcggcaagggcaccatgctgctggtgagccccgacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 559 - DNA, 819 bp, Homo sapiens
atggagaccctgctgggcgtgagcctggtgatcctgtggctgcagctggcccgcgtgaacagccagcagggcgaggaggacccccaggccctgagcatccaggagggcgagaacgccaccatgaactgcagctacaagaccagcatcaacaacctgcagtggtaccgccagaacagcggccgcggcctggtgcacctgatcctgatccgcagcaacgagcgcgagaagcacagcggccgcctgcgcgtgaccctggacaccagcaagaagagcagcagcctgctgatcaccgccagccgcgccgccgacaccgccagctacttctgcgccaccgagggcgacagcggctacagcaccctgaccttcggcaagggcaccatgctgctggtgagccccgacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 560 - DNA, 819 bp, Homo sapiens; identical to SEQ ID NO: 559

SEQ ID NO: 561 - DNA, 819 bp, Homo sapiens; identical to SEQ ID NO: 559

SEQ ID NO: 562 - DNA, 819 bp, Homo sapiens
atggagaccctgctgggcgtgagcctggtgatcctgtggctgcagctggcccgcgtgaacagccagcagggcgaggaggacccccaggccctgagcatccaggagggcgagaacgccaccatgaactgcagctacaagaccagcatcaacaacctgcagtggtaccgccagaacagcggccgcggcctggtgcacctgatcctgatccgcagcaacgagcgcgagaagcacagcggccgcctgcgcgtgaccctggacaccagcaagaagagcagcagcctgctgatcaccgccagccgcgccgccgacaccgccagctacttctgcgccaccagcggcgacagcggctacagcaccctgaccttcggcaagggcaccatgctgctggtgagccccgacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 563 - DNA, 819 bp, Homo sapiens
atggagaccctgctgggcgtgagcctggtgatcctgtggctgcagctggcccgcgtgaacagccagcagggcgaggaggacccccaggccctgagcatccaggagggcgagaacgccaccatgaactgcagctacaagaccagcatcaacaacctgcagtggtaccgccagaacagcggccgcggcctggtgcacctgatcctgatccgcagcaacgagcgcgagaagcacagcggccgcctgcgcgtgaccctggacaccagcaagaagagcagcagcctgctgatcaccgccagccgcgccgccgacaccgccagctacttctgcgccaccgtgggcaacagcggctacagcaccctgaccttcggcaagggcaccatgctgctggtgagccccgacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 564 - DNA, 819 bp, Homo sapiens; identical to SEQ ID NO: 563

SEQ ID NO: 565 - DNA, 819 bp, Homo sapiens
atggagaccctgctgggcgtgagcctggtgatcctgtggctgcagctggcccgcgtgaacagccagcagggcgaggaggacccccaggccctgagcatccaggagggcgagaacgccaccatgaactgcagctacaagaccagcatcaacaacctgcagtggtaccgccagaacagcggccgcggcctggtgcacctgatcctgatccgcagcaacgagcgcgagaagcacagcggccgcctgcgcgtgaccctggacaccagcaagaagagcagcagcctgctgatcaccgccagccgcgccgccgacaccgccagctacttctgcgccaccgtgggcgacagcggctacagcaccctgaccttcggcaagggcaccatgctgctggtgagccccgacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 566 - DNA, 819 bp, Homo sapiens; identical to SEQ ID NO: 563

SEQ ID NO: 567 - DNA, 819 bp, Homo sapiens; identical to SEQ ID NO: 563

SEQ ID NO: 568 - DNA, 819 bp, Homo sapiens
atggagaccctgctgggcgtgagcctggtgatcctgtggctgcagctggcccgcgtgaacagccagcagggcgaggaggacccccaggccctgagcatccaggagggcgagaacgccaccatgaactgcagctacaagaccagcatcaacaacctgcagtggtaccgccagaacagcggccgcggcctggtgcacctgatcctgatccgcagcaacgagcgcgagaagcacagcggccgcctgcgcgtgaccctggacaccagcaagaagagcagcagcctgctgatcaccgccagccgcgccgccgacaccgccagctacttctgcgccaccgagggcaacagcggctacagcaccctgaccttcggcaagggcaccatgctgctggtgagccccgacatccagaaccccgaccccgccgtgtaccagctgcgcgacagcaagagcagcgacaagagcgtgtgcctgttcaccgacttcgacagccagaccaacgtgagccagagcaaggacagcgacgtgtacatcaccgacaagtgcgtgctggacatgcgcagcatggacttcaagagcaacagcgccgtggcctggagcaacaagagcgacttcgcctgcgccaacgccttcaacaacagcatcatccccgaggacaccttcttccccagccccgagagcagctgcgacgtgaagctggtggagaagagcttcgagaccgacaccaacctgaacttccagaacctgagcgtgatcggcttccgcatcctgctgctgaaggtggccggcttcaacctgctgatgaccctgcgcctgtggagcagc

SEQ ID NO: 569 - DNA, 819 bp, Homo sapiens; identical to SEQ ID NO: 559

SEQ ID NO: 570 - DNA, 819 bp, Homo sapiens; identical to SEQ ID NO: 568

SEQ ID NO: 571 - DNA, 819 bp, Homo sapiens; identical to SEQ ID NO: 568

SEQ ID NO: 572 - DNA, 819 bp, Homo sapiens; identical to SEQ ID NO: 559

SEQ ID NO: 573 - DNA, 819 bp, Homo sapiens; identical to SEQ ID NO: 565

SEQ ID NO: 574 - DNA, 924 bp, Homo sapiens
atgggcccccagctgctgggctacgtggtgctgtgcctgctgggcgccggccccctggaggcccaggtgacccagaacccccgctacctgatcaccgtgaccggcaagaagctgaccgtgacctgcagccagaacatgaaccacgagtacatgagctggtaccgccaggaccccggcctgggcctgcgccagatctactacagcatgaacgtggaggtgaccgacaagggcgacgtgcccgagggctacaaggtgagccgcaaggagaagcgcaacttccccctgatcctggagagccccagccccaaccagaccagcctgtacttctgcgccagccgcaccggcggcgtgaacgagcagtacttcggccccggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 575 - DNA, 933 bp, Homo sapiens
atgggcttccgcctgctgtgctgcgtggccttctgcctgctgggcgccggccccgtggacagcggcgtgacccagacccccaagcacctgatcaccgccaccggccagcgcgtgaccctgcgctgcagcccccgcagcggcgacctgagcgtgtactggtaccagcagagcctggaccagggcctgcagttcctgatccagtactacaacggcgaggagcgcgccaagggcaacatcctggagcgcttcagcgcccagcagttccccgacctgcacagcgagctgaacctgagcagcctggagctgggcgacagcgccctgtacttctgcgccagcagcgccggccagggcctggccggcgacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 576 - DNA, 939 bp, Homo sapiens
atgggctgccgcctgctgtgctgcgccgtgctgtgcctgctgggcgccgtgcccatcgacaccgaggtgacccagacccccaagcacctggtgatgggcatgaccaacaagaagagcctgaagtgcgagcagcacatgggccaccgcgccatgtactggtacaagcagaaggccaagaagccccccgagctgatgttcgtgtacagctacgagaagctgagcatcaacgagagcgtgcccagccgcttcagccccgagtgccccaacagcagcctgctgaacctgcacctgcacgccctgcagcccgaggacagcgccctgtacctgtgcgccagcagccaggaggccgccagcggcggcctgatcaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 577 - DNA, 930 bp, Homo sapiens
atgggcccccagctgctgggctacgtggtgctgtgcctgctgggcgccggccccctggaggcccaggtgacccagaacccccgctacctgatcaccgtgaccggcaagaagctgaccgtgacctgcagccagaacatgaaccacgagtacatgagctggtaccgccaggaccccggcctgggcctgcgccagatctactacagcatgaacgtggaggtgaccgacaagggcgacgtgcccgagggctacaaggtgagccgcaaggagaagcgcaacttccccctgatcctggagagccccagccccaaccagaccagcctgtacttctgcgccagcagctacagcggcggccccctgtacgagcagtacttcggccccggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 578 - DNA, 930 bp, Homo sapiens
atgggcccccagctgctgggctacgtggtgctgtgcctgctgggcgccggccccctggaggcccaggtgacccagaacccccgctacctgatcaccgtgaccggcaagaagctgaccgtgacctgcagccagaacatgaaccacgagtacatgagctggtaccgccaggaccccggcctgggcctgcgccagatctactacagcatgaacgtggaggtgaccgacaagggcgacgtgcccgagggctacaaggtgagccgcaaggagaagcgcaacttccccctgatcctggagagccccagccccaaccagaccagcctgtacttctgcgccagcagctacgccggcggcccccagtacggctacaccttcggcagcggcacccgcctgaccgtggtggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 579 - DNA, 966 bp, Homo sapiens
atgctgctgctgctgctgctgctgggccccggcatcagcctgctgctgcccggcagcctggccggcagcggcctgggcgccgtggtgagccagcaccccagctgggtgatctgcaagagcggcaccagcgtgaagatcgagtgccgcagcctggacttccaggccaccaccatgttctggtaccgccagttccccaagcagagcctgatgctgatggccaccagcaacgagggcagcaaggccacctacgagcagggcgtggagaaggacaagttcctgatcaaccacgccagcctgaccctgagcaccctgaccgtgaccagcgcccaccccgaggacagcagcttctacatctgcagcgcccgcgacggcagccccatcgccggcggcctgaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 580 - DNA, 930 bp, Homo sapiens; identical to SEQ ID NO: 577

SEQ ID NO: 581 - DNA, 933 bp, Homo sapiens
atgggcttccgcctgctgtgctgcgtggccttctgcctgctgggcgccggccccgtggacagcggcgtgacccagacccccaagcacctgatcaccgccaccggccagcgcgtgaccctgcgctgcagcccccgcagcggcgacctgagcgtgtactggtaccagcagagcctggaccagggcctgcagttcctgatccagtactacaacggcgaggagcgcgccaagggcaacatcctggagcgcttcagcgcccagcagttccccgacctgcacagcgagctgaacctgagcagcctggagctgggcgacagcgccctgtacttctgcgccagcagcgtgggcgagggcctggccggcgacacccagtacttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 582 - DNA, 930 bp, Homo sapiens
atgggcccccagctgctgggctacgtggtgctgtgcctgctgggcgccggccccctggaggcccaggtgacccagaacccccgctacctgatcaccgtgaccggcaagaagctgaccgtgacctgcagccagaacatgaaccacgagtacatgagctggtaccgccaggaccccggcctgggcctgcgccagatctactacagcatgaacgtggaggtgaccgacaagggcgacgtgcccgagggctacaaggtgagccgcaaggagaagcgcaacttccccctgatcctggagagccccagccccaaccagaccagcctgtacttctgcgccagccgctacagcggcggccccctgtacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 583 - DNA, 966 bp, Homo sapiens; identical to SEQ ID NO: 579

SEQ ID NO: 584 - DNA, 930 bp, Homo sapiens
atgggctgccgcctgctgtgctgcgccgtgctgtgcctgctgggcgccgtgcccatcgacaccgaggtgacccagacccccaagcacctggtgatgggcatgaccaacaagaagagcctgaagtgcgagcagcacatgggccaccgcgccatgtactggtacaagcagaaggccaagaagccccccgagctgatgttcgtgtacagctacgagaagctgagcatcaacgagagcgtgcccagccgcttcagccccgagtgccccaacagcagcctgctgaacctgcacctgcacgccctgcagcccgaggacagcgccctgtacctgtgcgccagcagccaggaggccggccgccagaacacccagtacttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 585 - DNA, 924 bp, Homo sapiens
atgggcccccagctgctgggctacgtggtgctgtgcctgctgggcgccggccccctggaggcccaggtgacccagaacccccgctacctgatcaccgtgaccggcaagaagctgaccgtgacctgcagccagaacatgaaccacgagtacatgagctggtaccgccaggaccccggcctgggcctgcgccagatctactacagcatgaacgtggaggtgaccgacaagggcgacgtgcccgagggctacaaggtgagccgcaaggagaagcgcaacttccccctgatcctggagagccccagccccaaccagaccagcctgtacttctgcgccacccgcaccggcgccgtgaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 586 - DNA, 930 bp, Homo sapiens
atgggcatccgcctgctgtgccgcgtggccttctgcttcctggccgtgggcctggtggacgtgaaggtgacccagagcagccgctacctggtgaagcgcaccggcgagaaggtgttcctggagtgcgtgcaggacatggaccacgagaacatgttctggtaccgccaggaccccggcctgggcctgcgcctgatctacttcagctacgacgtgaagatgaaggagaagggcgacatccccgagggctacagcgtgagccgcgagaagaaggagcgcttcagcctgatcctggagagcgccagcaccaaccagaccagcatgtacctgtgcgccagcagccccgccggccgccccggcaagcccctgcacttcggcaacggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 587 - DNA, 924 bp, Homo sapiens
atgggcttccgcctgctgtgctgcgtggccttctgcctgctgggcgccggccccgtggacagcggcgtgacccagacccccaagcacctgatcaccgccaccggccagcgcgtgaccctgcgctgcagcccccgcagcggcgacctgagcgtgtactggtaccagcagagcctggaccagggcctgcagttcctgatccagtactacaacggcgaggagcgcgccaagggcaacatcctggagcgcttcagcgcccagcagttccccgacctgcacagcgagctgaacctgagcagcctggagctgggcgacagcgccctgtacttctgcgccagcagcgtggcccccttctacgagcagtacttcggccccggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 588 - DNA, 918 bp, Homo sapiens
atgctgtgcagcctgctggccctgctgctgggcaccttcttcggcgtgcgcagccagaccatccaccagtggcccgccaccctggtgcagcccgtgggcagccccctgagcctggagtgcaccgtggagggcaccagcaaccccaacctgtactggtaccgccaggccgccggccgcggcctgcagctgctgttctacagcgtgggcatcggccagatcagcagcgaggtgccccagaacctgagcgccagccgcccccaggaccgccagttcatcctgagcagcaagaagctgctgctgagcgacagcggcttctacctgtgcgcctggagcccccagggcaacagccccctgcacttcggcaacggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 589 - DNA, 933 bp, Homo sapiens
atggacacctggctggtgtgctgggccatcttcagcctgctgaaggccggcctgaccgagcccgaggtgacccagacccccagccaccaggtgacccagatgggccaggaggtgatcctgcgctgcgtgcccatcagcaaccacctgtacttctactggtaccgccagatcctgggccagaaggtggagttcctggtgagcttctacaacaacgagatcagcgagaagagcgagatcttcgacgaccagttcagcgtggagcgccccgacggcagcaacttcaccctgaagatccgcagcaccaagctggaggacagcgccatgtacttctgcgccagcagcgagagcggcagccccaccggcgagctgttcttcggcgagggcagccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 590 - DNA, 924 bp, Homo sapiens
atgggcttccgcctgctgtgctgcgtggccttctgcctgctgggcgccggccccgtggacagcggcgtgacccagacccccaagcacctgatcaccgccaccggccagcgcgtgaccctgcgctgcagcccccgcagcggcgacctgagcgtgtactggtaccagcagagcctggaccagggcctgcagttcctgatccagtactacaacggcgaggagcgcgccaagggcaacatcctggagcgcttcagcgcccagcagttccccgacctgcacagcgagctgaacctgagcagcctggagctgggcgacagcgccctgtacttctgcgccagcagcgtggccccctggtacgagcagtacttcggccccggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 591 - DNA, 924 bp, Homo sapiens
atgggcttccgcctgctgtgctgcgtggccttctgcctgctgggcgccggccccgtggacagcggcgtgacccagacccccaagcacctgatcaccgccaccggccagcgcgtgaccctgcgctgcagcccccgcagcggcgacctgagcgtgtactggtaccagcagagcctggaccagggcctgcagttcctgatccagtactacaacggcgaggagcgcgccaagggcaacatcctggagcgcttcagcgcccagcagttccccgacctgcacagcgagctgaacctgagcagcctggagctgggcgacagcgccctgtacttctgcgccagcagcgtgagcagctggtacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 592 - DNA, 927 bp, Homo sapiens
atgggcccccagctgctgggctacgtggtgctgtgcctgctgggcgccggccccctggaggcccaggtgacccagaacccccgctacctgatcaccgtgaccggcaagaagctgaccgtgacctgcagccagaacatgaaccacgagtacatgagctggtaccgccaggaccccggcctgggcctgcgccagatctactacagcatgaacgtggaggtgaccgacaagggcgacgtgcccgagggctacaaggtgagccgcaaggagaagcgcaacttccccctgatcctggagagccccagccccaaccagaccagcctgtacttctgcgccagcagcctgtggaccagcaacagccccctgcacttcggcaacggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 593 - DNA, 930 bp, Homo sapiens
atgggcacccgcctgttcttctacgtggccctgtgcctgctgtggaccggccacatggacgccggcatcacccagagcccccgccacaaggtgaccgagaccggcacccccgtgaccctgcgctgccaccagaccgagaaccaccgctacatgtactggtaccgccaggaccccggccacggcctgcgcctgatccactacagctacggcgtgaaggacaccgacaagggcgaggtgagcgacggctacagcgtgagccgcagcaagaccgaggacttcctgctgaccctggagagcgccaccagcagccagaccagcgtgtacttctgcgccatccgccgcggcggcagcagctacaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 594 - DNA, 933 bp, Homo sapiens
atgcgcatccgcctgctgtgctgcgtggccttcagcctgctgtgggccggccccgtgatcgccggcatcacccaggcccccaccagccagatcctggccgccggccgccgcatgaccctgcgctgcacccaggacatgcgccacaacgccatgtactggtaccgccaggacctgggcctgggcctgcgcctgatccactacagcaacaccgccggcaccaccggcaagggcgaggtgcccgacggctacagcgtgagccgcgccaacaccgacgacttccccctgaccctggccagcgccgtgcccagccagaccagcgtgtacttctgcgccagcagcgccgaccagggcgacggcaccgacacccagtacttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 595 - DNA, 930 bp, Homo sapiens
atgggcccccagctgctgggctacgtggtgctgtgcctgctgggcgccggccccctggaggcccaggtgacccagaacccccgctacctgatcaccgtgaccggcaagaagctgaccgtgacctgcagccagaacatgaaccacgagtacatgagctggtaccgccaggaccccggcctgggcctgcgccagatctactacagcatgaacgtggaggtgaccgacaagggcgacgtgcccgagggctacaaggtgagccgcaaggagaagcgcaacttccccctgatcctggagagccccagccccaaccagaccagcctgtacttctgcgccagcagcctgaacaccggcatgaacaccgaggccttcttcggccagggcacccgcctgaccgtggtggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 596 - DNA, 930 bp, Homo sapiens
atgggcttccgcctgctgtgctgcgtggccttctgcctgctgggcgccggccccgtggacagcggcgtgacccagacccccaagcacctgatcaccgccaccggccagcgcgtgaccctgcgctgcagcccccgcagcggcgacctgagcgtgtactggtaccagcagagcctggaccagggcctgcagttcctgatccagtactacaacggcgaggagcgcgccaagggcaacatcctggagcgcttcagcgcccagcagttccccgacctgcacagcgagctgaacctgagcagcctggagctgggcgacagcgccctgtacttctgcgccagcagccgccccgagggcatctacaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 597 - DNA, 927 bp, Homo sapiens
atgagcaaccaggtgctgtgctgcgtggtgctgtgcttcctgggcgccaacaccgtggacggcggcatcacccagagccccaagtacctgttccgcaaggagggccagaacgtgaccctgagctgcgagcagaacctgaaccacgacgccatgtactggtaccgccaggaccccggccagggcctgcgcctgatctactacagccagatcgtgaacgacttccagaagggcgacatcgccgagggctacagcgtgagccgcgagaagaaggagagcttccccctgaccgtgaccagcgcccagaagaaccccaccgccttctacctgtgcgccagcagccccggcctggccgactacgagcagtacttcggccccggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 598 - DNA, 924 bp, Homo sapiens
atgctgtgcagcctgctggccctgctgctgggcaccttcttcggcgtgcgcagccagaccatccaccagtggcccgccaccctggtgcagcccgtgggcagccccctgagcctggagtgcaccgtggagggcaccagcaaccccaacctgtactggtaccgccaggccgccggccgcggcctgcagctgctgttctacagcgtgggcatcggccagatcagcagcgaggtgccccagaacctgagcgccagccgcccccaggaccgccagttcatcctgagcagcaagaagctgctgctgagcgacagcggcttctacctgtgcgcctggcgcctggagcagggcctgaactacgagcagtacttcggccccggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 599 - DNA, 936 bp, Homo sapiens
atgggcacccgcctgctgtgctgggccgccctgtgcctgctgggcgccgagctgaccgaggccggcgtggcccagagcccccgctacaagatcatcgagaagcgccagagcgtggccttctggtgcaaccccatcagcggccacgccaccctgtactggtaccagcagatcctgggccagggccccaagctgctgatccagttccagaacaacggcgtggtggacgacagccagctgcccaaggaccgcttcagcgccgagcgcctgaagggcgtggacagcaccctgaagatccagcccgccaagctggaggacagcgccgtgtacctgtgcgccagcagcctgttccccggcaccggcatccacgagcagtacttcggccccggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 600 - DNA, 936 bp, Homo sapiens
atgaccatccgcctgctgtgctacatgggcttctacttcctgggcgccggcctgatggaggccgacatctaccagaccccccgctacctggtgatcggcaccggcaagaagatcaccctggagtgcagccagaccatgggccacgacaagatgtactggtaccagcaggaccccggcatggagctgcacctgatccactacagctacggcgtgaacagcaccgagaagggcgacctgagcagcgagagcaccgtgagccgcatccgcaccgagcacttccccctgaccctggagagcgcccgccccagccacaccagccagtacctgtgcgccagcagccccctgggccgcagcagcagctacaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 601 - DNA, 936 bp, Homo sapiens
atgaccatccgcctgctgtgctacatgggcttctacttcctgggcgccggcctgatggaggccgacatctaccagaccccccgctacctggtgatcggcaccggcaagaagatcaccctggagtgcagccagaccatgggccacgacaagatgtactggtaccagcaggaccccggcatggagctgcacctgatccactacagctacggcgtgaacagcaccgagaagggcgacctgagcagcgagagcaccgtgagccgcatccgcaccgagcacttccccctgaccctggagagcgcccgccccagccacaccagccagtacctgtgcgccagcagcgccctgggccagagcagcagctacaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 602 - DNA, 936 bp, Homo sapiens
atgaccatccgcctgctgtgctacatgggcttctacttcctgggcgccggcctgatggaggccgacatctaccagaccccccgctacctggtgatcggcaccggcaagaagatcaccctggagtgcagccagaccatgggccacgacaagatgtactggtaccagcaggaccccggcatggagctgcacctgatccactacagctacggcgtgaacagcaccgagaagggcgacctgagcagcgagagcaccgtgagccgcatccgcaccgagcacttccccctgaccctggagagcgcccgccccagccacaccagccagtacctgtgcgccagcagcgacctgggccgcggcagcgccgtgaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 603 - DNA, 933 bp, Homo sapiens
atgggcaccagcctgctgtgctggatggccctgtgcctgctgggcgccgaccacgccgacaccggcgtgagccagaacccccgccacaagatcaccaagcgcggccagaacgtgaccttccgctgcgaccccatcagcgagcacaaccgcctgtactggtaccgccagaccctgggccagggccccgagttcctgacctacttccagaacgaggcccagctggagaagagccgcctgctgagcgaccgcttcagcgccgagcgccccaagggcagcttcagcaccctggagatccagcgcaccgagcagggcgacagcgccatgtacctgtgcgccagcagccccctggaccgcggcacctacgagcagtacttcggccccggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 604 - DNA, 933 bp, Homo sapiens
atgggcaccagcctgctgtgctggatggccctgtgcctgctgggcgccgaccacgccgacaccggcgtgagccagaacccccgccacaagatcaccaagcgcggccagaacgtgaccttccgctgcgaccccatcagcgagcacaaccgcctgtactggtaccgccagaccctgggccagggccccgagttcctgacctacttccagaacgaggcccagctggagaagagccgcctgctgagcgaccgcttcagcgccgagcgccccaagggcagcttcagcaccctggagatccagcgcaccgagcagggcgacagcgccatgtacctgtgcgccagcagccccctggagcgcggcacctacgagcagtacttcggccccggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 605 - DNA, 933 bp, Homo sapiens
atgggcaccagcctgctgtgctggatggccctgtgcctgctgggcgccgaccacgccgacaccggcgtgagccagaacccccgccacaagatcaccaagcgcggccagaacgtgaccttccgctgcgaccccatcagcgagcacaaccgcctgtactggtaccgccagaccctgggccagggccccgagttcctgacctacttccagaacgaggcccagctggagaagagccgcctgctgagcgaccgcttcagcgccgagcgccccaagggcagcttcagcaccctggagatccagcgcaccgagcagggcgacagcgccatgtacctgtgcgccagcagcctgctgagcagcggcgactacgagcagtacttcggccccggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 606 - DNA, 933 bp, Homo sapiens
atgagcaaccaggtgctgtgctgcgtggtgctgtgcttcctgggcgccaacaccgtggacggcggcatcacccagagccccaagtacctgttccgcaaggagggccagaacgtgaccctgagctgcgagcagaacctgaaccacgacgccatgtactggtaccgccaggaccccggccagggcctgcgcctgatctactacagccagatcgtgaacgacttccagaagggcgacatcgccgagggctacagcgtgagccgcgagaagaaggagagcttccccctgaccgtgaccagcgcccagaagaaccccaccgccttctacctgtgcgccagcagcaagggcgccagcggcatgcgcaccgagcagtacttcggccccggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 607 - DNA, 933 bp, Homo sapiens
atggccagcctgctgttcttctgcggcgccttctacctgctgggcaccggcagcatggacgccgacgtgacccagaccccccgcaaccgcatcaccaagaccggcaagcgcatcatgctggagtgcagccagaccaagggccacgaccgcatgtactggtaccgccaggaccccggcctgggcctgcgcctgatctactacagcttcgacgtgaaggacatcaacaagggcgagatcagcgacggctacagcgtgagccgccaggcccaggccaagttcagcctgagcctggagagcgccatccccaaccagaccgccctgtacttctgcgccaccagcgacaccaccagcacccgccccaccgagcagtacgtgggccccggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 608 - DNA, 933 bp, Homo sapiens
atggacacctggctggtgtgctgggccatcttcagcctgctgaaggccggcctgaccgagcccgaggtgacccagacccccagccaccaggtgacccagatgggccaggaggtgatcctgcgctgcgtgcccatcagcaaccacctgtacttctactggtaccgccagatcctgggccagaaggtggagttcctggtgagcttctacaacaacgagatcagcgagaagagcgagatcttcgacgaccagttcagcgtggagcgccccgacggcagcaacttcaccctgaagatccgcagcaccaagctggaggacagcgccatgtacttctgcgccagcagcgccaccagcggcagctacaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 609 - DNA, 933 bp, Homo sapiens
atgctgagcctgctgctgctgctgctgggcctgggcagcgtgttcagcgccgtgatcagccagaagcccagccgcgacatctgccagcgcggcaccagcctgaccatccagtgccaggtggacagccaggtgaccatgatgttctggtaccgccagcagcccggccagagcctgaccctgatcgccaccgccaaccagggcagcgaggccacctacgagagcggcttcgtgatcgacaagttccccatcagccgccccaacctgaccttcagcaccctgaccgtgagcaacatgagccccgaggacagcagcatctacctgtgcagcgtgggcgagggcaccagcggctacgagagctacaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 610 - DNA, 933 bp, Homo sapiens
atgggcaccagcctgctgtgctggatggccctgtgcctgctgggcgccgaccacgccgacaccggcgtgagccagaacccccgccacaagatcaccaagcgcggccagaacgtgaccttccgctgcgaccccatcagcgagcacaaccgcctgtactggtaccgccagaccctgggccagggccccgagttcctgacctacttccagaacgaggcccagctggagaagagccgcctgctgagcgaccgcttcagcgccgagcgccccaagggcagcttcagcaccctggagatccagcgcaccgagcagggcgacagcgccatgtacctgtgcgccagcagcagcctggaccgcggcgactacgagcagtacttcggccccggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 611 - DNA, 933 bp, Homo sapiens
atgggcaccagcctgctgtgctggatggccctgtgcctgctgggcgccgaccacgccgacaccggcgtgagccagaacccccgccacaagatcaccaagcgcggccagaacgtgaccttccgctgcgaccccatcagcgagcacaaccgcctgtactggtaccgccagaccctgggccagggccccgagttcctgacctacttccagaacgaggcccagctggagaagagccgcctgctgagcgaccgcttcagcgccgagcgccccaagggcagcttcagcaccctggagatccagcgcaccgagcagggcgacagcgccatgtacctgtgcgccagccagaaccgccgcgagggccgcagcgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 612 - DNA, 927 bp, Homo sapiens
atgggcatccgcctgctgtgccgcgtggccttctgcttcctggccgtgggcctggtggacgtgaaggtgacccagagcagccgctacctggtgaagcgcaccggcgagaaggtgttcctggagtgcgtgcaggacatggaccacgagaacatgttctggtaccgccaggaccccggcctgggcctgcgcctgatctacttcagctacgacgtgaagatgaaggagaagggcgacatccccgagggctacagcgtgagccgcgagaagaaggagcgcttcagcctgatcctggagagcgccagcaccaaccagaccagcatgtacctgtgcgccagcatcaagagcagcggctacaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 613 - DNA, 927 bp, Homo sapiens
atgggcatccgcctgctgtgccgcgtggccttctgcttcctggccgtgggcctggtggacgtgaaggtgacccagagcagccgctacctggtgaagcgcaccggcgagaaggtgttcctggagtgcgtgcaggacatggaccacgagaacatgttctggtaccgccaggaccccggcctgggcctgcgcctgatctacttcagctacgacgtgaagatgaaggagaagggcgacatccccgagggctacagcgtgagccgcgagaagaaggagcgcttcagcctgatcctggagagcgccagcaccaaccagaccagcatgtacctgtgcgccagcatcctgagcagcggctacaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 614 - DNA, 933 bp, Homo sapiens; identical to SEQ ID NO: 609

SEQ ID NO: 615 - DNA, 921 bp, Homo sapiens
atgctgtgcagcctgctggccctgctgctgggcaccttcttcggcgtgcgcagccagaccatccaccagtggcccgccaccctggtgcagcccgtgggcagccccctgagcctggagtgcaccgtggagggcaccagcaaccccaacctgtactggtaccgccaggccgccggccgcggcctgcagctgctgttctacagcgtgggcatcggccagatcagcagcgaggtgccccagaacctgagcgccagccgcccccaggaccgccagttcatcctgagcagcaagaagctgctgctgagcgacagcggcttctacctgtgcgcctgccagtggcagggcctgggcggcgagctgttcttcggcgagggcagccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 616 - DNA, 933 bp, Homo sapiens
atgggcttccgcctgctgtgctgcgtggccttctgcctgctgggcgccggccccgtggacagcggcgtgacccagacccccaagcacctgatcaccgccaccggccagcgcgtgaccctgcgctgcagcccccgcagcggcgacctgagcgtgtactggtaccagcagagcctggaccagggcctgcagttcctgatccagtactacaacggcgaggagcgcgccaagggcaacatcctggagcgcttcagcgcccagcagttccccgacctgcacagcgagctgaacctgagcagcctggagctgggcgacagcgccctgtacttctgcgccagcagccccggccagcgcgccaacaccggcgagctgttcttcggcgagggcagccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 617 - DNA, 921 bp, Homo sapiens
atgggcacccgcctgttcttctacgtggccctgtgcctgctgtgggccggccaccgcgacgccggcatcacccagagcccccgctacaagatcaccgagaccggccgccaggtgaccctgatgtgccaccagacctggagccacagctacatgttctggtaccgccaggacctgggccacggcctgcgcctgatctactacagcgccgccgccgacatcaccgacaagggcgaggtgcccgacggctacgtggtgagccgcagcaagaccgagaacttccccctgaccctggagagcgccacccgcagccagaccagcgtgtacttctgcgccagcagctacgagaacgagaagctgttcttcggcagcggcacccagctgagcgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 618 - DNA, 921 bp, Homo sapiens
atggacacctggctggtgtgctgggccatcttcagcctgctgaaggccggcctgaccgagcccgaggtgacccagacccccagccaccaggtgacccagatgggccaggaggtgatcctgcgctgcgtgcccatcagcaaccacctgtacttctactggtaccgccagatcctgggccagaaggtggagttcctggtgagcttctacaacaacgagatcagcgagaagagcgagatcttcgacgaccagttcagcgtggagcgccccgacggcagcaacttcaccctgaagatccgcagcaccaagctggaggacagcgccatgtacttctgcgccagcagctggggcaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 619 - DNA, 936 bp, Homo sapiens
atgggcacccgcctgctgttctgggtggccttctgcctgctgggcgccgaccacaccggcgccggcgtgagccagagccccagcaacaaggtgaccgagaagggcaaggacgtggagctgcgctgcgaccccatcagcggccacaccgccctgtactggtaccgccagagcctgggccagggcctggagttcctgatctacttccagggcaacagcgcccccgacaagagcggcctgcccagcgaccgcttcagcgccgagcgcaccggcggcagcgtgagcaccctgaccatccagcgcacccagcaggaggacagcgccgtgtacctgtgcgccagcagcttcatcggcggcaccggcctgaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 620 - DNA, 963 bp, Homo sapiens
atgctgctgctgctgctgctgctgggccccggcatcagcctgctgctgcccggcagcctggccggcagcggcctgggcgccgtggtgagccagcaccccagctgggtgatctgcaagagcggcaccagcgtgaagatcgagtgccgcagcctggacttccaggccaccaccatgttctggtaccgccagttccccaagcagagcctgatgctgatggccaccagcaacgagggcagcaaggccacctacgagcagggcgtggagaaggacaagttcctgatcaaccacgccagcctgaccctgagcaccctgaccgtgaccagcgcccaccccgaggacagcagcttctacatctgcagcgcccgcgaccgcttctggggcaccaacaacgagaagctgttcttcggcagcggcacccagctgagcgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 621 - DNA, 930 bp, Homo sapiens
atgctgtgcagcctgctggccctgctgctgggcaccttcttcggcgtgcgcagccagaccatccaccagtggcccgccaccctggtgcagcccgtgggcagccccctgagcctggagtgcaccgtggagggcaccagcaaccccaacctgtactggtaccgccaggccgccggccgcggcctgcagctgctgttctacagcgtgggcatcggccagatcagcagcgaggtgccccagaacctgagcgccagccgcccccaggaccgccagttcatcctgagcagcaagaagctgctgctgagcgacagcggcttctacctgtgcgcctggagcagcgcccccgaccgcggccaccgccagccccagcacttcggcgacggcacccgcctgagcatcctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 622 - DNA, 936 bp, Homo sapiens
atgggccccggcctgctgcactggatggccctgtgcctgctgggcaccggccacggcgacgccatggtgatccagaacccccgctaccaggtgacccagttcggcaagcccgtgaccctgagctgcagccagaccctgaaccacaacgtgatgtactggtaccagcagaagagcagccaggcccccaagctgctgttccactactacgacaaggacttcaacaacgaggccgacacccccgacaacttccagagccgccgccccaacaccagcttctgcttcctggacatccgcagccccggcctgggcgacaccgccatgtacctgtgcgccaccagccgcgaccgcggcaccggccccccctacgagcagtacttcggccccggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 623 - DNA, 924 bp, Homo sapiens
atgagcatcggcctgctgtgctgcgtggccttcagcctgctgtgggccagccccgtgaacgccggcgtgacccagacccccaagttccaggtgctgaagaccggccagagcatgaccctgcagtgcgcccaggacatgaaccacaacagcatgtactggtaccgccaggaccccggcatgggcctgcgcctgatctactacagcgccagcgagggcaccaccgacaagggcgaggtgcccaacggctacaacgtgagccgcctgaacaagcgcgagttcagcctgcgcctggagagcgccgcccccagccagaccagcgtgtacttctgcgccagcagcgagtggcgcgaggagacccagtacttcggccccggcacccgcctgctggtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 624 - DNA, 921 bp, Homo sapiens
atgctgtgcagcctgctggccctgctgctgggcaccttcttcggcgtgcgcagccagaccatccaccagtggcccgccaccctggtgcagcccgtgggcagccccctgagcctggagtgcaccgtggagggcaccagcaaccccaacctgtactggtaccgccaggccgccggccgcggcctgcagctgctgttctacagcgtgggcatcggccagatcagcagcgaggtgccccagaacctgagcgccagccgcccccaggaccgccagttcatcctgagcagcaagaagctgctgctgagcgacagcggcttctacctgtgcgcctggagcggcaccgacagcagctacgagcagtacttcggccccggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 625 - DNA, 933 bp, Homo sapiens
atgggcatccgcctgctgtgccgcgtggccttctgcttcctggccgtgggcctggtggacgtgaaggtgacccagagcagccgctacctggtgaagcgcaccggcgagaaggtgttcctggagtgcgtgcaggacatggaccacgagaacatgttctggtaccgccaggaccccggcctgggcctgcgcctgatctacttcagctacgacgtgaagatgaaggagaagggcgacatccccgagggctacagcgtgagccgcgagaagaaggagcgcttcagcctgatcctggagagcgccagcaccaaccagaccagcatgtacctgtgcgccagcagccccgagcagggcgccgccggcgacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 626 - DNA, 930 bp, Homo sapiens
atgggcttccgcctgctgtgctgcgtggccttctgcctgctgggcgccggccccgtggacagcggcgtgacccagacccccaagcacctgatcaccgccaccggccagcgcgtgaccctgcgctgcagcccccgcagcggcgacctgagcgtgtactggtaccagcagagcctggaccagggcctgcagttcctgatccagtactacaacggcgaggagcgcgccaagggcaacatcctggagcgcttcagcgcccagcagttccccgacctgcacagcgagctgaacctgagcagcctggagctgggcgacagcgccctgtacttctgcgccagcagccccagctgggccgccaacagccccctgcacttcggcaacggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 627 - DNA, 924 bp, Homo sapiens
atgggcatccgcctgctgtgccgcgtggccttctgcttcctggccgtgggcctggtggacgtgaaggtgacccagagcagccgctacctggtgaagcgcaccggcgagaaggtgttcctggagtgcgtgcaggacatggaccacgagaacatgttctggtaccgccaggaccccggcctgggcctgcgcctgatctacttcagctacgacgtgaagatgaaggagaagggcgacatccccgagggctacagcgtgagccgcgagaagaaggagcgcttcagcctgatcctggagagcgccagcaccaaccagaccagcatgtacctgtgcgccagcggcaccctgagctacaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 628 - DNA, 933 bp, Homo sapiens
atgggcaccagcctgctgtgctggatggccctgtgcctgctgggcgccgaccacgccgacaccggcgtgagccagaacccccgccacaagatcaccaagcgcggccagaacgtgaccttccgctgcgaccccatcagcgagcacaaccgcctgtactggtaccgccagaccctgggccagggccccgagttcctgacctacttccagaacgaggcccagctggagaagagccgcctgctgagcgaccgcttcagcgccgagcgccccaagggcagcttcagcaccctggagatccagcgcaccgagcagggcgacagcgccatgtacctgtgcgccagcagcctggtgggccagggcaacaccgaggccttcttcggccagggcacccgcctgaccgtggtggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 629 - DNA, 936 bp, Homo sapiens
atgggcacccgcctgctgtgctgggccgccctgtgcctgctgggcgccgagctgaccgaggccggcgtggcccagagcccccgctacaagatcatcgagaagcgccagagcgtggccttctggtgcaaccccatcagcggccacgccaccctgtactggtaccagcagatcctgggccagggccccaagctgctgatccagttccagaacaacggcgtggtggacgacagccagctgcccaaggaccgcttcagcgccgagcgcctgaagggcgtggacagcaccctgaagatccagcccgccaagctggaggacagcgccgtgtacctgtgcgccagcagcctggacgagggcaccgtgacctacgagcagtacttcggccccggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 630 - DNA, 924 bp, Homo sapiens
atgggcttccgcctgctgtgctgcgtggccttctgcctgctgggcgccggccccgtggacagcggcgtgacccagacccccaagcacctgatcaccgccaccggccagcgcgtgaccctgcgctgcagcccccgcagcggcgacctgagcgtgtactggtaccagcagagcctggaccagggcctgcagttcctgatccagtactacaacggcgaggagcgcgccaagggcaacatcctggagcgcttcagcgcccagcagttccccgacctgcacagcgagctgaacctgagcagcctggagctgggcgacagcgccctgtacttctgcgccagcagcgtgggcggcgagggcctggccttcttcggccagggcacccgcctgaccgtggtggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 631 - DNA, 930 bp, Homo sapiens
atgggcaccagcctgctgtgctgggtggtgctgggcttcctgggcaccgaccacaccggcgccggcgtgagccagagcccccgctacaaggtgaccaagcgcggccaggacgtggccctgcgctgcgaccccatcagcggccacgtgagcctgtactggtaccgccaggccctgggccagggccccgagttcctgacctacttcaactacgaggcccagcaggacaagagcggcctgcccaacgaccgcttcagcgccgagcgccccgagggcagcatcagcaccctgaccatccagcgcaccgagcagcgcgacagcgccatgtaccgctgcgccagcagcctggagggcgactacaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 632 - DNA, 930 bp, Homo sapiens
atgggcaccagcctgctgtgctgggtggtgctgggcttcctgggcaccgaccacaccggcgccggcgtgagccagagcccccgctacaaggtgaccaagcgcggccaggacgtggccctgcgctgcgaccccatcagcggccacgtgagcctgtactggtaccgccaggccctgggccagggccccgagttcctgacctacttcaactacgaggcccagcaggacaagagcggcctgcccaacgaccgcttcagcgccgagcgccccgagggcagcatcagcaccctgaccatccagcgcaccgagcagcgcgacagcgccatgtaccgctgcgccagcagcctggaggccgacaacgagaagctgttcttcggcagcggcacccagctgagcgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 633 - DNA, 927 bp, Homo sapiens
atgggcttccgcctgctgtgctgcgtggccttctgcctgctgggcgccggccccgtggacagcggcgtgacccagacccccaagcacctgatcaccgccaccggccagcgcgtgaccctgcgctgcagcccccgcagcggcgacctgagcgtgtactggtaccagcagagcctggaccagggcctgcagttcctgatccagtactacaacggcgaggagcgcgccaagggcaacatcctggagcgcttcagcgcccagcagttccccgacctgcacagcgagctgaacctgagcagcctggagctgggcgacagcgccctgtacttctgcgccagcagcgtgggcgacagcggccaggcccagtacttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 634 - DNA, 930 bp, Homo sapiens
atgggccccggcctgctgtgctgggccctgctgtgcctgctgggcgccggcctggtggacgccggcgtgacccagagccccacccacctgatcaagacccgcggccagcaggtgaccctgcgctgcagccccaagagcggccacgacaccgtgagctggtaccagcaggccctgggccagggcccccagttcatcttccagtactacgaggaggaggagcgccagcgcggcaacttccccgaccgcttcagcggccaccagttccccaactacagcagcgagctgaacgtgaacgccctgctgctgggcgacagcgccctgtacctgtgcgccagcagctggtgggacggcggcaccggcgagctgttcttcggcgagggcagccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 635 - DNA, 924 bp, Homo sapiens
atggccagcctgctgttcttctgcggcgccttctacctgctgggcaccggcagcatggacgccgacgtgacccagaccccccgcaaccgcatcaccaagaccggcaagcgcatcatgctggagtgcagccagaccaagggccacgaccgcatgtactggtaccgccaggaccccggcctgggcctgcgcctgatctactacagcttcgacgtgaaggacatcaacaagggcgagatcagcgacggctacagcgtgagccgccaggcccaggccaagttcagcctgagcctggagagcgccatccccaaccagaccgccctgtacttctgcgccacccgcgacgacctgctggccgaggccttcttcggccagggcacccgcctgaccgtggtggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 636 - DNA, 957 bp, Homo sapiens
atgctgagccccgacctgcccgacagcgcctggaacacccgcctgctgtgccacgtgatgctgtgcctgctgggcgccgtgagcgtggccgccggcgtgatccagagcccccgccacctgatcaaggagaagcgcgagaccgccaccctgaagtgctaccccatcccccgccacgacaccgtgtactggtaccagcagggccccggccaggacccccagttcctgatcagcttctacgagaagatgcagagcgacaagggcagcatccccgaccgcttcagcgcccagcagttcagcgactaccacagcgagctgaacatgagcagcctggagctgggcgacagcgccctgtacttctgcgccagcagcttcggcaccaacaccggcgagctgttcttcggcgagggcagccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 637 - DNA, 927 bp, Homo sapiens
atgagcacccgcctgctgtgctggatggccctgtgcctgctgggcgccgagctgagcgaggccgaggtggcccagagcccccgctacaagatcaccgagaagagccaggccgtggccttctggtgcgaccccatcagcggccacgccaccctgtactggtaccgccagatcctgggccagggccccgagctgctggtgcagttccaggacgagagcgtggtggacgacagccagctgcccaaggaccgcttcagcgccgagcgcctgaagggcgtggacagcaccctgaagatccagcccgccgagctgggcgacagcgccatgtacctgtgcgccagcagcttcggccagtacaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 638 - DNA, 927 bp, Homo sapiens
atgagcatcggcctgctgtgctgcgccgccctgagcctgctgtgggccggccccgtgaacgccggcgtgacccagacccccaagttccaggtgctgaagaccggccagagcatgaccctgcagtgcgcccaggacatgaaccacgagtacatgagctggtaccgccaggaccccggcatgggcctgcgcctgatccactacagcgtgggcgccggcatcaccgaccagggcgaggtgcccaacggctacaacgtgagccgcagcaccaccgaggacttccccctgcgcctgctgagcgccgcccccagccagaccagcgtgtacttctgcgccagcagctacggcggcggctactacggctacaccttcggcagcggcacccgcctgaccgtggtggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 639 - DNA, 930 bp, Homo sapiens
atgagcatcggcctgctgtgctgcgccgccctgagcctgctgtgggccggccccgtgaacgccggcgtgacccagacccccaagttccaggtgctgaagaccggccagagcatgaccctgcagtgcgcccaggacatgaaccacgagtacatgagctggtaccgccaggaccccggcatgggcctgcgcctgatccactacagcgtgggcgccggcatcaccgaccagggcgaggtgcccaacggctacaacgtgagccgcagcaccaccgaggacttccccctgcgcctgctgagcgccgcccccagccagaccagcgtgtacttctgcgccagcagctaccagggcaccggcgcctacggctacaccttcggcagcggcacccgcctgaccgtggtggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 640 - DNA, 927 bp, Homo sapiens
atgagcatcggcctgctgtgctgcgccgccctgagcctgctgtgggccggccccgtgaacgccggcgtgacccagacccccaagttccaggtgctgaagaccggccagagcatgaccctgcagtgcgcccaggacatgaaccacgagtacatgagctggtaccgccaggaccccggcatgggcctgcgcctgatccactacagcgtgggcgccggcatcaccgaccagggcgaggtgcccaacggctacaacgtgagccgcagcaccaccgaggacttccccctgcgcctgctgagcgccgcccccagccagaccagcgtgtacttctgcgccagcagctaccagggcggcagctacggctacaccttcggcagcggcacccgcctgaccgtggtggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 641 - DNA, 927 bp, Homo sapiens
atgagcatcggcctgctgtgctgcgccgccctgagcctgctgtgggccggccccgtgaacgccggcgtgacccagacccccaagttccaggtgctgaagaccggccagagcatgaccctgcagtgcgcccaggacatgaaccacgagtacatgagctggtaccgccaggaccccggcatgggcctgcgcctgatccactacagcgtgggcgccggcatcaccgaccagggcgaggtgcccaacggctacaacgtgagccgcagcaccaccgaggacttccccctgcgcctgctgagcgccgcccccagccagaccagcgtgtacttctgcgccagcagccgccagggcggcagctacggctacaccttcggcagcggcacccgcctgaccgtggtggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 642 - DNA, 927 bp, Homo sapiens
atgagcatcggcctgctgtgctgcgccgccctgagcctgctgtgggccggccccgtgaacgccggcgtgacccagacccccaagttccaggtgctgaagaccggccagagcatgaccctgcagtgcgcccaggacatgaaccacgagtacatgagctggtaccgccaggaccccggcatgggcctgcgcctgatccactacagcgtgggcgccggcatcaccgaccagggcgaggtgcccaacggctacaacgtgagccgcagcaccaccgaggacttccccctgcgcctgctgagcgccgcccccagccagaccagcgtgtacttctgcgccagcagcccccagggcggcaactacggctacaccttcggcagcggcacccgcctgaccgtggtggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 643 - DNA, 927 bp, Homo sapiens; identical to SEQ ID NO: 642

SEQ ID NO: 644 - DNA, 924 bp, Homo sapiens
atgagcatcggcctgctgtgctgcgccgccctgagcctgctgtgggccggccccgtgaacgccggcgtgacccagacccccaagttccaggtgctgaagaccggccagagcatgaccctgcagtgcgcccaggacatgaaccacgagtacatgagctggtaccgccaggaccccggcatgggcctgcgcctgatccactacagcgtgggcgccggcatcaccgaccagggcgaggtgcccaacggctacaacgtgagccgcagcaccaccgaggacttccccctgcgcctgctgagcgccgcccccagccagaccagcgtgtacttctgcgccagcagcttccagggcggcaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 645 - DNA, 927 bp, Homo sapiens
atgagcatcggcctgctgtgctgcgccgccctgagcctgctgtgggccggccccgtgaacgccggcgtgacccagacccccaagttccaggtgctgaagaccggccagagcatgaccctgcagtgcgcccaggacatgaaccacgagtacatgagctggtaccgccaggaccccggcatgggcctgcgcctgatccactacagcgtgggcgccggcatcaccgaccagggcgaggtgcccaacggctacaacgtgagccgcagcaccaccgaggacttccccctgcgcctgctgagcgccgcccccagccagaccagcgtgtacttctgcgccagcagcacccagggcggctaccagccccagcacttcggcgacggcacccgcctgagcatcctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 646 - DNA, 927 bp, Homo sapiens
atgagcatcggcctgctgtgctgcgccgccctgagcctgctgtgggccggccccgtgaacgccggcgtgacccagacccccaagttccaggtgctgaagaccggccagagcatgaccctgcagtgcgcccaggacatgaaccacgagtacatgagctggtaccgccaggaccccggcatgggcctgcgcctgatccactacagcgtgggcgccggcatcaccgaccagggcgaggtgcccaacggctacaacgtgagccgcagcaccaccgaggacttccccctgcgcctgctgagcgccgcccccagccagaccagcgtgtacttctgcgccagcagccgccagggcggcatcgacggctacaccttcggcagcggcacccgcctgaccgtggtggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 647 - DNA, 924 bp, Homo sapiens
atgagcatcggcctgctgtgctgcgccgccctgagcctgctgtgggccggccccgtgaacgccggcgtgacccagacccccaagttccaggtgctgaagaccggccagagcatgaccctgcagtgcgcccaggacatgaaccacgagtacatgagctggtaccgccaggaccccggcatgggcctgcgcctgatccactacagcgtgggcgccggcatcaccgaccagggcgaggtgcccaacggctacaacgtgagccgcagcaccaccgaggacttccccctgcgcctgctgagcgccgcccccagccagaccagcgtgtacttctgcgccagcagcaagcagggcggcaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 648 - DNA, 924 bp, Homo sapiens
atgagcatcggcctgctgtgctgcgccgccctgagcctgctgtgggccggccccgtgaacgccggcgtgacccagacccccaagttccaggtgctgaagaccggccagagcatgaccctgcagtgcgcccaggacatgaaccacgagtacatgagctggtaccgccaggaccccggcatgggcctgcgcctgatccactacagcgtgggcgccggcatcaccgaccagggcgaggtgcccaacggctacaacgtgagccgcagcaccaccgaggacttccccctgcgcctgctgagcgccgcccccagccagaccagcgtgtacttctgcgccagcagcccccagggcggcaacgagcagttcttcggccccggcacccgcctgaccgtgctggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 649 - DNA, 927 bp, Homo sapiens
atgagcatcggcctgctgtgctgcgccgccctgagcctgctgtgggccggccccgtgaacgccggcgtgacccagacccccaagttccaggtgctgaagaccggccagagcatgaccctgcagtgcgcccaggacatgaaccacgagtacatgagctggtaccgccaggaccccggcatgggcctgcgcctgatccactacagcgtgggcgccggcatcaccgaccagggcgaggtgcccaacggctacaacgtgagccgcagcaccaccgaggacttccccctgcgcctgctgagcgccgcccccagccagaccagcgtgtacttctgcgccagcaaccgccagggcggcaactacggctacaccttcggcagcggcacccgcctgaccgtggtggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 650 - DNA, 927 bp, Homo sapiens
atgagcatcggcctgctgtgctgcgccgccctgagcctgctgtgggccggccccgtgaacgccggcgtgacccagacccccaagttccaggtgctgaagaccggccagagcatgaccctgcagtgcgcccaggacatgaaccacgagtacatgagctggtaccgccaggaccccggcatgggcctgcgcctgatccactacagcgtgggcgccggcatcaccgaccagggcgaggtgcccaacggctacaacgtgagccgcagcaccaccgaggacttccccctgcgcctgctgagcgccgcccccagccagaccagcgtgtacttctgcgccagcagccgccagggcggcaactacggctacaccttcggcagcggcacccgcctgaccgtggtggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 651 - DNA, 930 bp, Homo sapiens
atgagcatcggcctgctgtgctgcgccgccctgagcctgctgtgggccggccccgtgaacgccggcgtgacccagacccccaagttccaggtgctgaagaccggccagagcatgaccctgcagtgcgcccaggacatgaaccacgagtacatgagctggtaccgccaggaccccggcatgggcctgcgcctgatccactacagcgtgggcgccggcatcaccgaccagggcgaggtgcccaacggctacaacgtgagccgcagcaccaccgaggacttccccctgcgcctgctgagcgccgcccccagccagaccagcgtgtacttctgcgccagcagccagcagggcggcgaccactacggctacaccttcggcagcggcacccgcctgaccgtggtggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 652 - DNA, 927 bp, Homo sapiens
atgagcatcggcctgctgtgctgcgccgccctgagcctgctgtgggccggccccgtgaacgccggcgtgacccagacccccaagttccaggtgctgaagaccggccagagcatgaccctgcagtgcgcccaggacatgaaccacgagtacatgagctggtaccgccaggaccccggcatgggcctgcgcctgatccactacagcgtgggcgccggcatcaccgaccagggcgaggtgcccaacggctacaacgtgagccgcagcaccaccgaggacttccccctgcgcctgctgagcgccgcccccagccagaccagcgtgtacttctgcgccagcagcccccagggcggcagccgcggctacaccttcggcagcggcacccgcctgaccgtggtggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 653 - DNA, 927 bp, Homo sapiens
atgagcatcggcctgctgtgctgcgccgccctgagcctgctgtgggccggccccgtgaacgccggcgtgacccagacccccaagttccaggtgctgaagaccggccagagcatgaccctgcagtgcgcccaggacatgaaccacgagtacatgagctggtaccgccaggaccccggcatgggcctgcgcctgatccactacagcgtgggcgccggcatcaccgaccagggcgaggtgcccaacggctacaacgtgagccgcagcaccaccgaggacttccccctgcgcctgctgagcgccgcccccagccagaccagcgtgtacttctgcgccagccgcctgcagggcggcttcaacggctacaccttcggcagcggcacccgcctgaccgtggtggaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 654 - DNA, 927 bp, Homo sapiens
atgagcatcggcctgctgtgctgcgccgccctgagcctgctgtgggccggccccgtgaacgccggcgtgacccagacccccaagttccaggtgctgaagaccggccagagcatgaccctgcagtgcgcccaggacatgaaccacgagtacatgagctggtaccgccaggaccccggcatgggcctgcgcctgatccactacagcgtgggcgccggcatcaccgaccagggcgaggtgcccaacggctacaacgtgagccgcagcaccaccgaggacttccccctgcgcctgctgagcgccgcccccagccagaccagcgtgtacttctgcgccagcagcgtgcagggcggcgcccacgagcagtacttcggccccggcacccgcctgaccgtgaccgaggacctgaacaaggtgttcccccccgaggtggccgtgttcgagcccagcgaggccgagatcagccacacccagaaggccaccctggtgtgcctggccaccggcttcttccccgaccacgtggagctgagctggtgggtgaacggcaaggaggtgcacagcggcgtgtgcaccgacccccagcccctgaaggagcagcccgccctgaacgacagccgctactgcctgagcagccgcctgcgcgtgagcgccaccttctggcagaacccccgcaaccacttccgctgccaggtgcagttctacggcctgagcgagaacgacgagtggacccaggaccgcgccaagcccgtgacccagatcgtgagcgccgaggcctggggccgcgccgactgcggcttcaccagcgtgagctaccagcagggcgtgctgagcgccaccatcctgtacgagatcctgctgggcaaggccaccctgtacgccgtgctggtgagcgccctggtgctgatggccatggtgaagcgcaaggacttc

SEQ ID NO: 655 - protein, 273 aa, Homo sapiens
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVYSGAGSYQLTFGKGTKLSVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 656 - protein, 269 aa, Homo sapiens
MWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVGGNTGGFKTIFGAGTRLFVKANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 657 - protein, 277 aa, Homo sapiens
MLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALSEARGSQGNLIFGKGTKLSVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 658 - protein, 269 aa, Homo sapiens
MKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILRDVTGGFKTIFGAGTRLFVKANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 659 - protein, 271 aa, Homo sapiens
MLLEHLLIILWMQLTWVSGQQLNQSPQSMFIQEGEDVSMNCTSSSIFNTWLWYKQDPGEGPVLLIALYKAGELTSNGRLTAQFGITRKDSFLNISASIPSDVGIYFCAGRGSYNFNKFYFGSGTKLNVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 660 - protein, 265 aa, Homo sapiens
MWGAFLLYVSMKMGGTAGQSLEQPSEVTAVEGAIVQINCTYQTSGFYGLSWYQQHDGGAPTFLSYNALDGLEETGRFSSFLSRSDSYGYLLLQELQMKDSASYFCASSEGKLIFGQGTELSVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 661 - protein, 270 aa, Homo sapiens
MKPTLISVLVIIFILRGTRAQRVTQPEKLLSVFKGAPVELKCNYSYSGSPELFWYVQYSRQRLQLLLRHISRESIKGFTADLNKGETSFHLKKPFAQEEDSAMYYCALRWQTGANNLFFGTGTRLTVIPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 662 - protein, 269 aa, Homo sapiens
MWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVNGGTGGFKTIFGAGTRLFVKANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 663 - protein, 275 aa, Homo sapiens
MEKNPLAAPLLILWFHLDCVSSILNVEQSPQSLHVQEGDSTNFTCSFPSSNFYALHWYRWETAKSPEALFVMTLNGDEKKKGRISATLNTKEGYSYLYIKGSQPEDSATYLCASPRTGFQKLVFGTGTRLLVSPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 664 - protein, 265 aa, Homo sapiens
MWGAFLLYVSMKMGGTAGQSLEQPSEVTAVEGAIVQINCTYQTSGFYGLSWYQQHDGGAPTFLSYNALDGLEETGRFSSFLSRSDSYGYLLLQELQMKDSASYFCASTEGKLIFGQGTELSVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 665 - protein, 277 aa, Homo sapiens
MTRVSLLWAVVVSTCLESGMAQTVTQSQPEMSVQEAETVTLSCTYDTSENNYYLFWYKQPPSRQMILVIRQEAYKQQNATENRFSVNFQKAAKSFSLKISDSQLGDTAMYFCAFMTVYNQGGKLIFGQGTELSVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 666 - protein, 273 aa, Homo sapiens
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAPYSGAGAYQLTFGKGTKLSVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 667 - protein, 274 aa, Homo sapiens
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVWAGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 668 - protein, 268 aa, Homo sapiens
MKRILGALLGLLSAQVCCVRGIQVEQSPPDLILQEGANSTLRCNFSDSVNNLQWFHQNPWGQLINLFYIPSGTKQNGRLSATTVATERYSLLYISSSQTTDSGVYFCAVVINNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 669 - protein, 274 aa, Homo sapiens
MASAPISMLAMLFTLSGLRAQSVAQPEDQVNVAEGNPLTVKCTYSVSGNPYLFWYVQYPNRGLQFLLKYITGDNLVKGSYGFEAEFNKSQTSFHLKKPSALVSDSALYFCAVREASGANNLFFGTGTRLTVIPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 670 - protein, 276 aa, Homo sapiens
MLLLLVPVLEVIFTLGGTRAQSVTQLDSHVSVSEGTPVLLRCNYSSSYSPSLFWYVQHPNKGLQLLLKYTSAATLVKGINGFEAEFKKSETSFHLTKPSAHMSDAAEYFCVVSYLGDTGRRALTFGSGTRLQVQPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 671 - protein, 268 aa, Homo sapiens
MKRILGALLGLLSAQVCCVRGIQVEQSPPDLILQEGANSTLRCNFSDSVNNLQWFHQNPWGQLINLFYIPSGTKQNGRLSATTVATERYSLLYISSSQTTDSGVYFCAVVGNNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 672 - protein, 268 aa, Homo sapiens
MKRILGALLGLLSAQVCCVRGIQVEQSPPDLILQEGANSTLRCNFSDSVNNLQWFHQNPWGQLINLFYIPSGTKQNGRLSATTVATERYSLLYISSSQTTDSGVYFCAVLNNNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 673 - protein, 273 aa, Homo sapiens
MAGIRALFMYLWLQLDWVSRGESVGLHLPTLSVQEGDNSIINCAYSNSASDYFIWYKQESGKGPQFIIDIRSNMDKRQGQRVTVLLNKTVKHLSLQIAATQPGDSAVYFCAETPGGYQKVTFGTGTKLQVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 674 - protein, 278 aa, Homo sapiens
MAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAASAGGQNFVFGPGTRLSVLPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 675 - protein, 267 aa, Homo sapiens
MWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVKDSNYQLIWGAGTKLIIKPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 676 - protein, 269 aa, Homo sapiens
MWGAFLLYVSMKMGGTAGQSLEQPSEVTAVEGAIVQINCTYQTSGFYGLSWYQQHDGGAPTFLSYNALDGLEETGRFSSFLSRSDSYGYLLLQELQMKDSASYFCAVPRRNNNARLMFGDGTQLVVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 677 - protein, 276 aa, Homo sapiens
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVGGDDSGAGSYQLTFGKGTKLSVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 678 - protein, 272 aa, Homo sapiens
MLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGPGIYNQGGKLIFGQGTELSVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 679 - protein, 280 aa, Homo sapiens
MSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMSSSNAGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 680 - protein, 281 aa, Homo sapiens
MAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAASGLVEGNTPLVFGKGTRLSVIANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 681 - protein, 273 aa, Homo sapiens
METLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCATDGPYGNNRLAFGKGNQVVVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 682 - protein, 273 aa, Homo sapiens; identical to SEQ ID NO: 681

SEQ ID NO: 683 - protein, 273 aa, Homo sapiens
METLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCATDGRHGNNRLAFGKGNQVVVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 684 - protein, 271 aa, Homo sapiens
MLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGERGSTLGRLYFGRGTQLTVWPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 685 - protein, 271 aa, Homo sapiens; identical to SEQ ID NO: 684

SEQ ID NO: 686 - protein, 271 aa, Homo sapiens; identical to SEQ ID NO: 684

SEQ ID NO: 687 - protein, 273 aa, Homo sapiens
MTSIRAVFIFLWLQLDLVNGENVEQHPSTLSVQEGDSAVIKCTYSDSASNYFPWYKQELGKRPQLIIDIRSNVGEKKDQRIAVTLNKTAKHFSLHITETQPEDSAVYFCAAPRGAAGNKLTFGGGTRVLVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 688 - protein, 271 aa, Homo sapiens; identical to SEQ ID NO: 684

SEQ ID NO: 689 - protein, 271 aa, Homo sapiens
METLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCAALQGAQKLVFGQGTRLTINPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 690 - protein, 269 aa, Homo sapiens
MRQVARVIVFLTLSTLSLAKTTQPISMDSYEGQEVNITCSHNNIATNDYITWYQQFPSQGPRFIIQGYKTKVTNEVASLFIPADRKSSTLSLPRVSLSDTAVYYCLVVPFGGYNKLIFGAGTRLAVHPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 691 - protein, 271 aa, Homo sapiens; identical to SEQ ID NO: 684

SEQ ID NO: 692 - protein, 272 aa, Homo sapiens
METLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCAPDRPDTDKLIFGTGTRLQVFPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 693 - protein, 272 aa, Homo sapiens
MLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGPGTGAGSYQLTFGKGTKLSVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 694 - protein, 272 aa, Homo sapiens
MLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGPYSGAGSYQLTFGKGTKLSVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 695 - protein, 269 aa, Homo sapiens; identical to SEQ ID NO: 690

SEQ ID NO: 696 - protein, 275 aa, Homo sapiens
MKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNVGNTGFQKLVFGTGTRLLVSPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 697 - protein, 269 aa, Homo sapiens
MTSIRAVFIFLWLQLDLVNGENVEQHPSTLSVQEGDSAVIKCTYSDSASNYFPWYKQELGKGPQLIIDIRSNVGEKKDQRIAVTLNKTAKHFSLHITETQPEDSAVYFCAASEFQFYFGTGTSLTVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 698 - protein, 275 aa, Homo sapiens
MSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMREGVDYQLIWGAGTKLIIKPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 699 - protein, 272 aa, Homo sapiens
MLLLLIPVLGMIFALRDARAQSVSQHNHHVILSEAASLELGCNYSYGGTVNLFWYVQYPGQHLQLLLKYFSGDPLVKGIKGFEAEFIKSKFSFNLRKPSVQWSDTAEYFCAVKANFNKFYFGSGTKLNVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 700 - protein, 273 aa, Homo sapiens
MKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAAEPFSSYKLIFGSGTRLLVRPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 701 - protein, 275 aa, Homo sapiens
MMKCPQALLAIFWLLLSWVSSEDKVVQSPLSLVVHEGDTVTLNCSYEVTNFRSLLWYKQEKKAPTFLFMLTSSGIEKKSGRLSSILDKKELSSILNITATQTGDSAIYLCAVESLIQGAQKLVFGQGTRLTINPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 702 - protein, 271 aa, Homo sapiens
MRLVARVTVFLTFGTIIDAKTTQPPSMDCAEGRAANLPCNHSTISGNEYVYWYRQIHSQGPQYIIHGLKNNETNEMASLIITEDRKSSTLILPHATLRDTAVYYCIVRVAGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 703 - protein, 277 aa, Homo sapiens
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRVNSGGYQKVTFGTGTKLQVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 704 - protein, 272 aa, Homo sapiens
MISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVLSGAGSYQLTFGKGTKLSVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 705 - protein, 275 aa, Homo sapiens
MESFLGGVLLILWLQVDWVKSQKIEQNSEALNIQEGKTATLTCNYTNYSPAYLQWYRQDPGRGPVFLLLIRENEKEKRKERLKVTFDTTLKQSLFHITASQPADSATYLCALDEGNTGFQKLVFGTGTRLLVSPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 706 - protein, 263 aa, Homo sapiens
MWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASRNTGFQKLVFGTGTRLLVSPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 707 - protein, 276 aa, Homo sapiens
MLLELIPLLGIHFVLRTARAQSVTQPDIHITVSEGASLELRCNYSYGATPYLFWYVQSPGQGLQLLLKYFSGDTLVQGIKGFEAEFKRSQSSFNLRKPSVHWSDAAEYFCAAPGVGSNSGYALNFGKGTSLLVTPHIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 708 - protein, 269 aa, Homo sapiens
MWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAGEDQTGANNLFFGTGTRLTVIPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 709 - protein, 274 aa, Homo sapiens
MKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVKVGTGFQKLVFGTGTRLLVSPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 710 - protein, 267 aa, Homo sapiens
MLLLLIPVLGMIFALRDARAQSVSQHNHHVILSEAASLELGCNYSYGGTVNLFWYVQYPGQHLQLLLKYFSGDPLVKGIKGFEAEFIKSKFSFNLRKPSVQWSDTAEYFCAVSMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 711 - protein, 277 aa, Homo sapiens
MKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNPTPSVGSNYKLTFGKGTLLTVNPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 712 - protein, 274 aa, Homo sapiens
MMKCPQALLAIFWLLLSWVSSEDKVVQSPLSLVVHEGDTVTLNCSYEVTNFRSLLWYKQEKKAPTFLFMLTSSGIEKKSGRLSSILDKKELFSILNITATQTGDSAVYLCAVAAENYGQNFVFGPGTRLSVLPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 713 - protein, 276 aa, Homo sapiens
MEKNPLAAPLLILWFHLDCVSSILNVEQSPQSLHVQEGDSTNFTCSFPSSNFYALHWYRWETAKSPEALFVMTLNGDEKKKGRISATLNTKEGYSYLYIKGSQPEDSATYLCAFISSGSARQLTFGSGTQLTVLPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 714 - protein, 277 aa, Homo sapiens
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREDLRSNDKVIFGPGTSLSVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 715 - protein, 273 aa, Homo sapiens
MLLLLIPVLGMIFALRDARAQSVSQHNHHVILSEAASLELGCNYSYGGTVNLFWYVQYPGQHLQLLLKYFSGDPLVKGIKGFEAEFIKSKFSFNLRKPSVQWSDTAEYFCAAGGGSQGNLIFGKGTKLSVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 716 - protein, 275 aa, Homo sapiens
MSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMRELNDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 717 - protein, 268 aa, Homo sapiens
METLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCATDGLPRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 718 - protein, 276 aa, Homo sapiens
MLLLLIPVLGMIFALRDARAQSVSQHNHHVILSEAASLELGCNYSYGGTVNLFWYVQYPGQHLQLLLKYFSGDPLVKGIKGFEAEFIKSKFSFNLRKPSVQWSDTAEYFCAVNRPSGGSNYKLTFGKGTLLTVNPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 719 - protein, 273 aa, Homo sapiens
METLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCATTGNSGYSTLTFGKGTMLLVSPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 720 - protein, 273 aa, Homo sapiens
METLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCARVGDSGYSTLTFGKGTMLLVSPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 721 - protein, 273 aa, Homo sapiens
METLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCATEGDSGYSTLTFGKGTMLLVSPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 722 - protein, 273 aa, Homo sapiens; identical to SEQ ID NO: 721

SEQ ID NO: 723 - protein, 273 aa, Homo sapiens; identical to SEQ ID NO: 721

SEQ ID NO: 724 - protein, 273 aa, Homo sapiens
METLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCATSGDSGYSTLTFGKGTMLLVSPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 725 - protein, 273 aa, Homo sapiens
METLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCATVGNSGYSTLTFGKGTMLLVSPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 726 - protein, 273 aa, Homo sapiens; identical to SEQ ID NO: 725

SEQ ID NO: 727 - protein, 273 aa, Homo sapiens
METLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCATVGDSGYSTLTFGKGTMLLVSPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 728 - protein, 273 aa, Homo sapiens; identical to SEQ ID NO: 725

SEQ ID NO: 729 - protein, 273 aa, Homo sapiens; identical to SEQ ID NO: 725

SEQ ID NO: 730 - protein, 273 aa, Homo sapiens
METLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCATEGNSGYSTLTFGKGTMLLVSPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 731 - protein, 273 aa, Homo sapiens; identical to SEQ ID NO: 721

SEQ ID NO: 732 - protein, 273 aa, Homo sapiens; identical to SEQ ID NO: 730

SEQ ID NO: 733 - protein, 273 aa, Homo sapiens; identical to SEQ ID NO: 730

SEQ ID NO: 734 - protein, 273 aa, Homo sapiens; identical to SEQ ID NO: 721

SEQ ID NO: 735 - protein, 273 aa, Homo sapiens; identical to SEQ ID NO: 727

SEQ ID NO: 736 - protein, 308 aa, Homo sapiens
MGPQLLGYVVLCLLGAGPLEAQVTQNPRYLITVTGKKLTVTCSQNMNHEYMSWYRQDPGLGLRQIYYSMNVEVTDKGDVPEGYKVSRKEKRNFPLILESPSPNQTSLYFCASRTGGVNEQYFGPGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 737 - protein, 311 aa, Homo sapiens
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSAGQGLAGDEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 738 - protein, 313 aa, Homo sapiens
MGCRLLCCAVLCLLGAVPIDTEVTQTPKHLVMGMTNKKSLKCEQHMGHRAMYWYKQKAKKPPELMFVYSYEKLSINESVPSRFSPECPNSSLLNLHLHALQPEDSALYLCASSQEAASGGLINEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 739 - protein, 310 aa, Homo sapiens
MGPQLLGYVVLCLLGAGPLEAQVTQNPRYLITVTGKKLTVTCSQNMNHEYMSWYRQDPGLGLRQIYYSMNVEVTDKGDVPEGYKVSRKEKRNFPLILESPSPNQTSLYFCASSYSGGPLYEQYFGPGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 740 - protein, 310 aa, Homo sapiens
MGPQLLGYVVLCLLGAGPLEAQVTQNPRYLITVTGKKLTVTCSQNMNHEYMSWYRQDPGLGLRQIYYSMNVEVTDKGDVPEGYKVSRKEKRNFPLILESPSPNQTSLYFCASSYAGGPQYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 741 - protein, 322 aa, Homo sapiens
MLLLLLLLGPGISLLLPGSLAGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSARDGSPIAGGLNEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 742 - protein, 310 aa, Homo sapiens; identical to SEQ ID NO: 739

SEQ ID NO: 743 - protein, 311 aa, Homo sapiens
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGEGLAGDTQYFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 744 - protein, 310 aa, Homo sapiens
MGPQLLGYVVLCLLGAGPLEAQVTQNPRYLITVTGKKLTVTCSQNMNHEYMSWYRQDPGLGLRQIYYSMNVEVTDKGDVPEGYKVSRKEKRNFPLILESPSPNQTSLYFCASRYSGGPLYEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 745 - protein, 322 aa, Homo sapiens; identical to SEQ ID NO: 741

SEQ ID NO: 746 - protein, 310 aa, Homo sapiens
MGCRLLCCAVLCLLGAVPIDTEVTQTPKHLVMGMTNKKSLKCEQHMGHRAMYWYKQKAKKPPELMFVYSYEKLSINESVPSRFSPECPNSSLLNLHLHALQPEDSALYLCASSQEAGRQNTQYFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 747 - protein, 308 aa, Homo sapiens
MGPQLLGYVVLCLLGAGPLEAQVTQNPRYLITVTGKKLTVTCSQNMNHEYMSWYRQDPGLGLRQIYYSMNVEVTDKGDVPEGYKVSRKEKRNFPLILESPSPNQTSLYFCATRTGAVNEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 748 - protein, 310 aa, Homo sapiens
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPAGRPGKPLHFGNGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 749 - protein, 308 aa, Homo sapiens
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVAPFYEQYFGPGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 750 - protein, 306 aa, Homo sapiens
MLCSLLALLLGTFFGVRSQTIHQWPATLVQPVGSPLSLECTVEGTSNPNLYWYRQAAGRGLQLLFYSVGIGQISSEVPQNLSASRPQDRQFILSSKKLLLSDSGFYLCAWSPQGNSPLHFGNGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 751 - protein, 311 aa, Homo sapiens
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASSESGSPTGELFFGEGSRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 752 - protein, 308 aa, Homo sapiens
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVAPWYEQYFGPGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 753 - protein, 308 aa, Homo sapiens
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVSSWYEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 754 - protein, 309 aa, Homo sapiens
MGPQLLGYVVLCLLGAGPLEAQVTQNPRYLITVTGKKLTVTCSQNMNHEYMSWYRQDPGLGLRQIYYSMNVEVTDKGDVPEGYKVSRKEKRNFPLILESPSPNQTSLYFCASSLWTSNSPLHFGNGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 755 - protein, 310 aa, Homo sapiens
MGTRLFFYVALCLLWTGHMDAGITQSPRHKVTETGTPVTLRCHQTENHRYMYWYRQDPGHGLRLIHYSYGVKDTDKGEVSDGYSVSRSKTEDFLLTLESATSSQTSVYFCAIRRGGSSYNEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 756 - protein, 311 aa, Homo sapiens
MRIRLLCCVAFSLLWAGPVIAGITQAPTSQILAAGRRMTLRCTQDMRHNAMYWYRQDLGLGLRLIHYSNTAGTTGKGEVPDGYSVSRANTDDFPLTLASAVPSQTSVYFCASSADQGDGTDTQYFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 757 - protein, 310 aa, Homo sapiens
MGPQLLGYVVLCLLGAGPLEAQVTQNPRYLITVTGKKLTVTCSQNMNHEYMSWYRQDPGLGLRQIYYSMNVEVTDKGDVPEGYKVSRKEKRNFPLILESPSPNQTSLYFCASSLNTGMNTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 758 - protein, 310 aa, Homo sapiens
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSRPEGIYNEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 759 - protein, 309 aa, Homo sapiens
MSNQVLCCVVLCFLGANTVDGGITQSPKYLFRKEGQNVTLSCEQNLNHDAMYWYRQDPGQGLRLIYYSQIVNDFQKGDIAEGYSVSREKKESFPLTVTSAQKNPTAFYLCASSPGLADYEQYFGPGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 760 - protein, 308 aa, Homo sapiens
MLCSLLALLLGTFFGVRSQTIHQWPATLVQPVGSPLSLECTVEGTSNPNLYWYRQAAGRGLQLLFYSVGIGQISSEVPQNLSASRPQDRQFILSSKKLLLSDSGFYLCAWRLEQGLNYEQYFGPGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 761 - protein, 312 aa, Homo sapiens
MGTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLFPGTGIHEQYFGPGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 762 - protein, 312 aa, Homo sapiens
MTIRLLCYMGFYFLGAGLMEADIYQTPRYLVIGTGKKITLECSQTMGHDKMYWYQQDPGMELHLIHYSYGVNSTEKGDLSSESTVSRIRTEHFPLTLESARPSHTSQYLCASSPLGRSSSYNEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 763 - protein, 312 aa, Homo sapiens
MTIRLLCYMGFYFLGAGLMEADIYQTPRYLVIGTGKKITLECSQTMGHDKMYWYQQDPGMELHLIHYSYGVNSTEKGDLSSESTVSRIRTEHFPLTLESARPSHTSQYLCASSALGQSSSYNEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 764 - protein, 312 aa, Homo sapiens
MTIRLLCYMGFYFLGAGLMEADIYQTPRYLVIGTGKKITLECSQTMGHDKMYWYQQDPGMELHLIHYSYGVNSTEKGDLSSESTVSRIRTEHFPLTLESARPSHTSQYLCASSDLGRGSAVNEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 765 - protein, 311 aa, Homo sapiens
MGTSLLCWMALCLLGADHADTGVSQNPRHKITKRGQNVTFRCDPISEHNRLYWYRQTLGQGPEFLTYFQNEAQLEKSRLLSDRFSAERPKGSFSTLEIQRTEQGDSAMYLCASSPLDRGTYEQYFGPGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 766 - protein, 311 aa, Homo sapiens
MGTSLLCWMALCLLGADHADTGVSQNPRHKITKRGQNVTFRCDPISEHNRLYWYRQTLGQGPEFLTYFQNEAQLEKSRLLSDRFSAERPKGSFSTLEIQRTEQGDSAMYLCASSPLERGTYEQYFGPGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 767 - protein, 311 aa, Homo sapiens
MGTSLLCWMALCLLGADHADTGVSQNPRHKITKRGQNVTFRCDPISEHNRLYWYRQTLGQGPEFLTYFQNEAQLEKSRLLSDRFSAERPKGSFSTLEIQRTEQGDSAMYLCASSLLSSGDYEQYFGPGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 768 - protein, 311 aa, Homo sapiens
MSNQVLCCVVLCFLGANTVDGGITQSPKYLFRKEGQNVTLSCEQNLNHDAMYWYRQDPGQGLRLIYYSQIVNDFQKGDIAEGYSVSREKKESFPLTVTSAQKNPTAFYLCASSKGASGMRTEQYFGPGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 769 - protein, 311 aa, Homo sapiens
MASLLFFCGAFYLLGTGSMDADVTQTPRNRITKTGKRIMLECSQTKGHDRMYWYRQDPGLGLRLIYYSFDVKDINKGEISDGYSVSRQAQAKFSLSLESAIPNQTALYFCATSDTTSTRPTEQYVGPGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 770 - protein, 311 aa, Homo sapiens
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASSATSGSYNEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 771 - protein, 311 aa, Homo sapiens
MLSLLLLLLGLGSVFSAVISQKPSRDICQRGTSLTIQCQVDSQVTMMFWYRQQPGQSLTLIATANQGSEATYESGFVIDKFPISRPNLTFSTLTVSNMSPEDSSIYLCSVGEGTSGYESYNEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 772 - protein, 311 aa, Homo sapiens
MGTSLLCWMALCLLGADHADTGVSQNPRHKITKRGQNVTFRCDPISEHNRLYWYRQTLGQGPEFLTYFQNEAQLEKSRLLSDRFSAERPKGSFSTLEIQRTEQGDSAMYLCASSSLDRGDYEQYFGPGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 773 - protein, 311 aa, Homo sapiens
MGTSLLCWMALCLLGADHADTGVSQNPRHKITKRGQNVTFRCDPISEHNRLYWYRQTLGQGPEFLTYFQNEAQLEKSRLLSDRFSAERPKGSFSTLEIQRTEQGDSAMYLCASQNRREGRSEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 774 - protein, 309 aa, Homo sapiens
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASIKSSGYNEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 775 - protein, 309 aa, Homo sapiens
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASILSSGYNEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 776 - protein, 311 aa, Homo sapiens; identical to SEQ ID NO: 771

SEQ ID NO: 777 - protein, 307 aa, Homo sapiens
MLCSLLALLLGTFFGVRSQTIHQWPATLVQPVGSPLSLECTVEGTSNPNLYWYRQAAGRGLQLLFYSVGIGQISSEVPQNLSASRPQDRQFILSSKKLLLSDSGFYLCACQWQGLGGELFFGEGSRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 778 - protein, 311 aa, Homo sapiens
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSPGQRANTGELFFGEGSRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 779 - protein, 307 aa, Homo sapiens
MGTRLFFYVALCLLWAGHRDAGITQSPRYKITETGRQVTLMCHQTWSHSYMFWYRQDLGHGLRLIYYSAAADITDKGEVPDGYVVSRSKTENFPLTLESATRSQTSVYFCASSYENEKLFFGSGTQLSVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 780 - protein, 307 aa, Homo sapiens
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASSWGNEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 781 - protein, 312 aa, Homo sapiens
MGTRLLFWVAFCLLGADHTGAGVSQSPSNKVTEKGKDVELRCDPISGHTALYWYRQSLGQGLEFLIYFQGNSAPDKSGLPSDRFSAERTGGSVSTLTIQRTQQEDSAVYLCASSFIGGTGLNEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 782 - protein, 321 aa, Homo sapiens
MLLLLLLLGPGISLLLPGSLAGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSARDRFWGTNNEKLFFGSGTQLSVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 783 - protein, 310 aa, Homo sapiens
MLCSLLALLLGTFFGVRSQTIHQWPATLVQPVGSPLSLECTVEGTSNPNLYWYRQAAGRGLQLLFYSVGIGQISSEVPQNLSASRPQDRQFILSSKKLLLSDSGFYLCAWSSAPDRGHRQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 784 - protein, 312 aa, Homo sapiens
MGPGLLHWMALCLLGTGHGDAMVIQNPRYQVTQFGKPVTLSCSQTLNHNVMYWYQQKSSQAPKLLFHYYDKDFNNEADTPDNFQSRRPNTSFCFLDIRSPGLGDTAMYLCATSRDRGTGPPYEQYFGPGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 785 - protein, 308 aa, Homo sapiens
MSIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASSEWREETQYFGPGTRLLVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 786 - protein, 307 aa, Homo sapiens
MLCSLLALLLGTFFGVRSQTIHQWPATLVQPVGSPLSLECTVEGTSNPNLYWYRQAAGRGLQLLFYSVGIGQISSEVPQNLSASRPQDRQFILSSKKLLLSDSGFYLCAWSGTDSSYEQYFGPGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 787 - protein, 311 aa, Homo sapiens
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPEQGAAGDEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 788 - protein, 310 aa, Homo sapiens
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSPSWAANSPLHFGNGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 789 - protein, 308 aa, Homo sapiens
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASGTLSYNEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 790 - protein, 311 aa, Homo sapiens
MGTSLLCWMALCLLGADHADTGVSQNPRHKITKRGQNVTFRCDPISEHNRLYWYRQTLGQGPEFLTYFQNEAQLEKSRLLSDRFSAERPKGSFSTLEIQRTEQGDSAMYLCASSLVGQGNTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 791 - protein, 312 aa, Homo sapiens
MGTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLDEGTVTYEQYFGPGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 792 - protein, 308 aa, Homo sapiens
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGGEGLAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 793 - protein, 310 aa, Homo sapiens
MGTSLLCWVVLGFLGTDHTGAGVSQSPRYKVTKRGQDVALRCDPISGHVSLYWYRQALGQGPEFLTYFNYEAQQDKSGLPNDRFSAERPEGSISTLTIQRTEQRDSAMYRCASSLEGDYNEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 794 - protein, 310 aa, Homo sapiens
MGTSLLCWVVLGFLGTDHTGAGVSQSPRYKVTKRGQDVALRCDPISGHVSLYWYRQALGQGPEFLTYFNYEAQQDKSGLPNDRFSAERPEGSISTLTIQRTEQRDSAMYRCASSLEADNEKLFFGSGTQLSVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 795 - protein, 309 aa, Homo sapiens
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGDSGQAQYFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 796 - protein, 310 aa, Homo sapiens
MGPGLLCWALLCLLGAGLVDAGVTQSPTHLIKTRGQQVTLRCSPKSGHDTVSWYQQALGQGPQFIFQYYEEEERQRGNFPDRFSGHQFPNYSSELNVNALLLGDSALYLCASSWWDGGTGELFFGEGSRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 797 - protein, 308 aa, Homo sapiens
MASLLFFCGAFYLLGTGSMDADVTQTPRNRITKTGKRIMLECSQTKGHDRMYWYRQDPGLGLRLIYYSFDVKDINKGEISDGYSVSRQAQAKFSLSLESAIPNQTALYFCATRDDLLAEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 798 - protein, 319 aa, Homo sapiens
MLSPDLPDSAWNTRLLCHVMLCLLGAVSVAAGVIQSPRHLIKEKRETATLKCYPIPRHDTVYWYQQGPGQDPQFLISFYEKMQSDKGSIPDRFSAQQFSDYHSELNMSSLELGDSALYFCASSFGTNTGELFFGEGSRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 799 - protein, 309 aa, Homo sapiens
MSTRLLCWMALCLLGAELSEAEVAQSPRYKITEKSQAVAFWCDPISGHATLYWYRQILGQGPELLVQFQDESVVDDSQLPKDRFSAERLKGVDSTLKIQPAELGDSAMYLCASSFGQYNEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 800 - protein, 309 aa, Homo sapiens
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSYGGGYYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 801 - protein, 310 aa, Homo sapiens
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSYQGTGAYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 802 - protein, 309 aa, Homo sapiens
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSYQGGSYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 803 - protein, 309 aa, Homo sapiens
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSRQGGSYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 804 - protein, 309 aa, Homo sapiens
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSPQGGNYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 805 - protein, 309 aa, Homo sapiens; identical to SEQ ID NO: 804

SEQ ID NO: 806 - protein, 308 aa, Homo sapiens
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSFQGGNEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 807 - protein, 309 aa, Homo sapiens
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSTQGGYQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 808 - protein, 309 aa, Homo sapiens
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSRQGGIDGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 809 - protein, 308 aa, Homo sapiens
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSKQGGNEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 810 - protein, 308 aa, Homo sapiens
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSPQGGNEQFFGPGTRLTVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 811 - protein, 309 aa, Homo sapiens
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASNRQGGNYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 812 - protein, 309 aa, Homo sapiens
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSRQGGNYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 813 - protein, 310 aa, Homo sapiens
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSQQGGDHYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 814 - protein, 309 aa, Homo sapiens
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSPQGGSRGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 815 - protein, 309 aa, Homo sapiens
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASRLQGGFNGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 816 - protein, 309 aa, Homo sapiens
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSVQGGAHEQYFGPGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

The invention claimed is:

1. An isolated alpha chain and isolated beta chain of a T-cell receptor (TCR) or a fragment thereof, comprising the complementarity determining region (CDR) amino acid sequences listed below:

(a) Alpha chain CDRs 1, 2, and 3 comprising the amino acid sequences of SEQ ID Nos: 29, 191, and 3953; and beta chain CDRs 1, 2, and 3 comprising the amino acid sequences of SEQ ID Nos: 110, 272, and 434;

(b) Alpha chain CDRs 1, 2, and 3 comprising the amino acid sequences of SEQ ID Nos: 71, 233, and 395; and beta chain CDRs 1, 2, and 3 comprising the amino acid sequences of SEQ ID Nos: 152, 314, and 476;

(c) Alpha chain CDRs 1, 2, and 3 comprising the amino acid sequences of SEQ ID Nos: 82, 244, and 406; and beta chain CDRs 1, 2, and 3 comprising the amino acid sequences of SEQ ID Nos: 163, 325, and 487;

(d) Alpha chain CDRs 1, 2, and 3 comprising the amino acid sequences of SEQ ID Nos: 83, 245, and 407; and beta chain CDRs 1, 2, and 3 comprising the amino acid sequences of SEQ ID Nos: 164, 326, and 488;

(e) Alpha chain CDRs 1, 2, and 3 comprising the amino acid sequences of SEQ ID Nos: 45, 207, and 369; and beta chain CDRs 1, 2, and 3 comprising the amino acid sequences of SEQ ID Nos: 126, 288, and 450;

(f) Alpha chain CDRs 1, 2, and 3 comprising the amino acid sequences of SEQ ID Nos: 46, 208, and 370; and beta chain CDRs 1, 2, and 3 comprising the amino acid sequences of SEQ ID Nos: 127, 289, and 451;

(g) Alpha chain CDRs 1, 2, and 3 comprising the amino acid sequences of SEQ ID Nos: 36, 198, and 360; and beta chain CDRs 1, 2, and 3 comprising the amino acid sequences of SEQ ID Nos: 117, 279, and 441;

(h) Alpha chain CDRs 1, 2, and 3 comprising the amino acid sequences of SEQ ID Nos: 43, 205, and 367; and beta chain CDRs 1, 2, and 3 comprising the amino acid sequences of SEQ ID Nos: 124, 286, and 448;

(i) Alpha chain CDRs 1, 2, and 3 comprising the amino acid sequences of SEQ ID Nos: 14, 176, and 338; and beta chain CDRs 1, 2, and 3 comprising the amino acid sequences of SEQ ID Nos: 95, 257, and 419;

(j) Alpha chain CDRs 1, 2, and 3 comprising the amino acid sequences of SEQ ID Nos: 17, 179, and 341; and beta chain CDRs 1, 2, and 3 comprising the amino acid sequences of SEQ ID Nos: 98, 260, and 422.

2. The isolated alpha chain of claim 1, which comprises, consists essentially of, or consists of an amino acid sequence according to any one of SEQ ID NOS: 677, 719, 730, 731, 793, 694, 684, 691, 662, 665.

3. The isolated alpha chain of claim 1, comprising a cysteine residue at position 48 of a constant region thereof.

4. The isolated beta chain of claim 1, which comprises, consists essentially of or consists of an amino acid sequence according to any one of SEQ ID NOS: 758, 800, 811, 812, 774, 775, 765, 772, 743, 746.

5. The isolated beta chain of claim 1, comprising a cysteine residue at position 57 of a constant region thereof.

6. The isolated alpha chain of claim 1, comprising one or more amino acid substitutions at positions 90, 91, 92 and/or 93 of a constant region thereof.

7. The isolated beta chain of claim 1, comprising one or more amino acid substitutions at positions 18, 22, 133, 136 and/or 139 of a constant region thereof.

8. An isolated TCR or TCR fragment for binding an antigen derived from an Epstein Barr Virus (EBV), the TCR comprising:

an isolated alpha chain or fragment thereof and an isolated beta chain or fragment thereof, comprising the alpha chain complementary determining regions (CDRs) and beta chain complementary determining regions (CDRs) as listed below:

(a) Alpha chain CDRs 1, 2, and 3 comprising the amino acid sequences of SEQ ID Nos: 29, 191, and 353; and beta chain CDRs 1, 2, and 3 comprising the amino acid sequences of SEQ ID Nos: 110, 272, and 434;

(b) Alpha chain CDRs 1, 2, and 3 comprising the amino acid sequences of SEQ ID Nos: 71, 233, and 395; and beta chain CDRs 1, 2, and 3 comprising the amino acid sequences of SEQ ID Nos: 152, 314, and 476;

(c) Alpha chain CDRs 1, 2, and 3 comprising the amino acid sequences of SEQ ID Nos: 82, 244, and 406; and beta chain CDRs 1, 2, and 3 comprising the amino acid sequences of SEQ ID Nos: 163, 325, and 487;

(d) Alpha chain CDRs 1, 2, and 3 comprising the amino acid sequences of SEQ ID Nos: 83, 245, and 407; and beta chain CDRs 1, 2, and 3 comprising the amino acid sequences of SEQ ID Nos: 164, 326, and 488;

(e) Alpha chain CDRs 1, 2, and 3 comprising the amino acid sequences of SEQ ID Nos: 45, 207, and 369; and beta chain CDRs 1, 2, and 3 comprising the amino acid sequences of SEQ ID Nos: 126, 288, and 450;

(f) Alpha chain CDRs 1, 2, and 3 comprising the amino acid sequences of SEQ ID Nos: 46, 208, and 370; and beta chain CDRs 1, 2, and 3 comprising the amino acid sequences of SEQ ID Nos: 127, 289, and 451;

(g) Alpha chain CDRs 1, 2, and 3 comprising the amino acid sequences of SEQ ID Nos: 36, 198, and 360; and beta chain CDRs 1, 2, and 3 comprising the amino acid sequences of SEQ ID Nos: 117, 279, and 441;

(h) Alpha chain CDRs 1, 2, and 3 comprising the amino acid sequences of SEQ ID Nos: 43, 205, and 367; and beta chain CDRs 1, 2, and 3 comprising the amino acid sequences of SEQ ID Nos: 124, 286, and 448;

(i) Alpha chain CDRs 1, 2, and 3 comprising the amino acid sequences of SEQ ID Nos: 14, 176, and 338; and beta chain CDRs 1, 2, and 3 comprising the amino acid sequences of SEQ ID Nos: 95, 257, and 419;

(j) Alpha chain CDRs 1, 2, and 3 comprising the amino acid sequences of SEQ ID Nos: 17, 179, and 341; and beta chain CDRs 1, 2, and 3 comprising the amino acid sequences of SEQ ID Nos: 98, 260, and 422.

9. The isolated TCR of claim 8, wherein the antigen is derived from latent membrane protein 1 (LMP-1) and/or latent membrane protein 2 (LMP-2).

10. The isolated TCR of claim 8, wherein the alpha chain and the beta chain are joined by a linker.

11. A composition comprising:

an isolated TCR or TCR fragment according to claim 8;

and a pharmaceutically acceptable carrier, diluent or excipient.

12. An isolated nucleic acid encoding:

(i) an isolated alpha chain or fragment thereof according to claim 1;

(ii) an isolated beta chain or fragment thereof according to claim 1; or (iii) an isolated TCR or TCR fragment according to claim 8.

13. A genetic construct comprising the isolated nucleic acid of claim 12.

14. A host cell comprising the genetic construct of claim 13.

15. The host cell of claim 14, wherein the host cell is a T cell.

* * * * *